US011466082B2

(12) United States Patent
Diem et al.

(10) Patent No.: US 11,466,082 B2
(45) Date of Patent: Oct. 11, 2022

(54) ANTI-CD33 ANTIBODIES, ANTI-CD33/ANTI-CD3 BISPECIFIC ANTIBODIES AND USES THEREOF

(71) Applicant: Janssen Biotech, Inc., Horsham, PA (US)

(72) Inventors: Michael Diem, Spring House, PA (US); Francois Gaudet, Princeton, NJ (US); Ronan McDaid, Eagleville, PA (US); Priyanka Nair-Gupta, Spring House, PA (US)

(73) Assignee: JANSSEN BIOTECH, INC., Horsham, PA (US)

( * ) Notice: Subject to any disclaimer, the term of this patent is extended or adjusted under 35 U.S.C. 154(b) by 332 days.

(21) Appl. No.: 16/418,420

(22) Filed: May 21, 2019

(65) Prior Publication Data

US 2019/0382481 A1 Dec. 19, 2019

Related U.S. Application Data

(60) Provisional application No. 62/825,846, filed on Mar. 29, 2019, provisional application No. 62/676,123, filed on May 24, 2018.

(51) Int. Cl.
| | | |
|---|---|---|
| A61P 35/02 | (2006.01) | |
| C07K 16/28 | (2006.01) | |
| A61K 47/68 | (2017.01) | |
| A61P 35/00 | (2006.01) | |
| C07K 16/46 | (2006.01) | |
| A61K 39/00 | (2006.01) | |

(52) U.S. Cl.
CPC ...... *C07K 16/2803* (2013.01); *A61K 47/6849* (2017.08); *A61P 35/00* (2018.01); *A61P 35/02* (2018.01); *C07K 16/2809* (2013.01); *C07K 16/468* (2013.01); *A61K 2039/505* (2013.01); *C07K 2317/14* (2013.01); *C07K 2317/21* (2013.01); *C07K 2317/24* (2013.01); *C07K 2317/31* (2013.01); *C07K 2317/55* (2013.01); *C07K 2317/565* (2013.01); *C07K 2317/732* (2013.01); *C07K 2317/734* (2013.01); *C07K 2317/76* (2013.01); *C07K 2317/92* (2013.01)

(58) Field of Classification Search
CPC ............ C07K 16/2803; C07K 16/2809; C07K 2317/565; C07K 2317/21; C07K 2317/56; C07K 2317/00; A61K 47/6849; A61P 35/02
USPC .......................................... 424/133.1, 136.1
See application file for complete search history.

(56) References Cited

U.S. PATENT DOCUMENTS

| | | |
|---|---|---|
| 6,737,056 B1 | 5/2004 | Presta |
| 8,236,308 B2 | 8/2012 | Kischel et al. |
| 9,359,442 B2 | 6/2016 | Hoffee et al. |
| 9,803,029 B2 | 10/2017 | Ellwanger et al. |
| 2009/0182127 A1 | 7/2009 | Kjaergaard et al. |
| 2009/0252683 A1 | 10/2009 | Kischel et al. |
| 2010/0015133 A1 | 1/2010 | Igawa et al. |
| 2010/0028637 A1 | 2/2010 | Tavsanli et al. |
| 2010/0150918 A1 | 6/2010 | Kufer et al. |
| 2010/0183615 A1 | 7/2010 | Kufer et al. |
| 2011/0123532 A1 | 5/2011 | Gurney et al. |
| 2011/0262439 A1 | 10/2011 | Kufer et al. |
| 2011/0275787 A1 | 10/2011 | Kufer et al. |
| 2011/0293619 A1 | 12/2011 | Kufer et al. |
| 2012/0149876 A1 | 6/2012 | Von Kreudenstein et al. |
| 2013/0039913 A1 | 2/2013 | Labrijn et al. |
| 2013/0195849 A1 | 8/2013 | Spreter Von Kreudenstein et al. |
| 2020/0048349 A1* | 2/2020 | Gaudet ............ A61K 39/39541 |

FOREIGN PATENT DOCUMENTS

| | | |
|---|---|---|
| CL | 2013000669 | 2/2014 |
| CL | 2016001477 | 1/2017 |
| CL | 2016000564 | 3/2017 |
| CL | 2019003095 | 2/2020 |
| CL | 2020002143 | 3/2021 |
| WO | WO 2000/041474 A2 | 7/2000 |
| WO | WO 2006/028936 A2 | 3/2006 |
| WO | WO 2007/042261 A2 | 4/2007 |
| WO | WO 2008/119565 A2 | 10/2008 |
| WO | WO 2008/119566 A2 | 10/2008 |
| WO | WO 2008/119567 A2 | 10/2008 |
| WO | WO 2010/037836 A2 | 4/2010 |
| WO | WO 2010/037837 A2 | 4/2010 |
| WO | WO 2010/037838 A2 | 4/2010 |
| WO | WO 2011/131746 A2 | 10/2011 |
| WO | WO 2012/045752 | 4/2012 |
| WO | WO 2014/093908 A2 | 6/2014 |
| WO | WO 2015/036583 | 3/2015 |
| WO | WO 2015/089344 | 6/2015 |
| WO | WO 2016/201388 A2 | 12/2016 |
| WO | WO 2019/028283 | 2/2019 |
| WO | WO 2019/164929 | 8/2019 |

OTHER PUBLICATIONS

Bost et al. (Immunol. Invest. (1988) 17:577-586).*
Bendayan (J. Histochem. Cytochem. (1995) 43:881-886).*
Brummell etal. (Biochemistry 32:1180-1187 (1993)).*
Kobayashi etal. (Protein Engineering 12:879-844 (1999)).*
Burks etal. (PNAS 94:412-417 (1997)).*
Jang etal. (Molec. Immunol. 35:1207-1217 (1998)).*
Brorson et at. (J. Immunol. 163:6694-6701 (1999)).*
Coleman (Research in Immunol. 145:33-36 (1994)).*
Biotechnology, Chemical, Pharmaceutical (BCP) Partnership Meeting (SPE Dan Kolker, Sep. 17, 2020; pp. 1-36.*

(Continued)

*Primary Examiner* — Lynn A Bristol
(74) *Attorney, Agent, or Firm* — Riverside Law LLP

(57) ABSTRACT

Anti-CD33 antibodies and antigen-binding fragments thereof and anti-CD33/anti-CD3 bispecific antibodies or antigen-binding fragments thereof are described. Also described are nucleic acids encoding the antibodies, compositions comprising the antibodies, methods of producing the antibodies, and methods of using the antibodies for treating or preventing diseases, such as cancer.

21 Claims, 23 Drawing Sheets

Specification includes a Sequence Listing.

(56) References Cited

OTHER PUBLICATIONS

See MacCallum et al. (J. Mol. Biol. (1996) 262:732-745).*
De Pascalis et al. (The Journal of Immunology (2002) 169, 3076-3084).*
Casset et al. ((2003) BBRC 307, 198-205).*
Vajdos et al. ((2002) J. Mol. Biol. 320, 415-428).*
Holm et al ((2007) Mol. Immunol. 44: 1075-1084).*
Chen et al. (J. Mol. Bio. (1999) 293, 865-881).*
Wu et al. (J. Mol. Biol. (1999) 294, 151-162).*
Nair-Gupta et al (Blood ADV Mar. 10, 2020; 4(5): 906-919).*
Hoseini et al (J Immunother Cancer. 2021; 9(5): e002509).*
Pérez-Oliva et al. (Glycobiology vol. 21 No. 6 pp. 757-770, 2011).*
International Search Report of the International Searching Authority relating to corresponding International Patent Application No. PCT/IB2019/054182, filed May 21, 2019. Dated Nov. 28, 2019.
Written Opinion of the International Searching Authority relating to corresponding International Patent Application No. PCT/IB2019/054182, filed May 21, 2019. Dated Nov. 28, 2019.
Altschul et al. "Gapped BLAST and PSI-BLAST: a new generation of protein database search programs.", *Nucleic Acids Res.*, 1997, pp. 3389-3402, vol. 25(17).
Altschul et al., "Basic Local Alignment Search Tool.", *J. Mol. Biol.*, 1990, pp. 403-410, vol. 215.
Anasetti et al., "Treatment of Acute Graft-Versus-Host Disease With A Nonmitogenic Anti-CD3 Monoclonal Antibody.", *Transplantation*, 1992, pp. 844-851, vol. 54(5).
Andrews et al.,"Myeloid-Associated Differentiation Antigens on Stem Cells and Their Progeny Identified by Monoclonal Antibodies.", *Blood*, 1983, pp. 124-132, vol. 62(1).
Ausubel et al., "Current Protocols in Molecular Biology", *New Biological Books*, Jun. 1991, pp. 199-200.
Ball et al., "Two new IgA$_{1-\kappa}$ plasma cell leukaemia cell lines (JJN-1 & JJN-2) which proliferate in response to B cell stimulatory factor 2.", *Clin. Exp. Immunol.*, 1989, pp. 93099, vol. 75.
Burnett et al., "Therapeutic Advances in Acute Myeloid Leukemia.", Journal of Clinical Oncology, Feb. 10, 2011, pp. 487-494, vol. 29(5).
Chames and Baty, "Biospecific antibodies for cancer therapy.", *Curr. Opin. Drug Disc. Dev.*, 2009, pp. 1-14, vol. 12(2).
Ferrara et al., "Modulation of Therapeutic Antibody Effector Functions by Glycosylation Engineering: Influence of Golgi Enzyme Localization Domain and Co-Expression of Heterologous b1, 4-N-acetylglucosaminyltransferase III and Golgi a-mannosidase II.", *Biotechnol. Bioengineering*, Apr. 5, 2006, pp. 851-861, vol. 93(5).
Ferrara et al., The Carbohydrate at FcγRIIIa Asn-162. An Element Required for High Affinity Binding to Non-Fucosylated IgG Glycoforms*., *J Biol Chem*, 2006; pp. 5032-5036, vol. (8).
Friedrich et al., "Preclinical Characterization of AMG 330, a CD3/CD33-Bispecific T-Cell-Engaging Antibody with Potential for Treatment of Acute Myelogenous Leukemia.", *Molecular Cancer Therapies*, Jun. 2014, pp. 1549-1567, vol. 13(6).
Godwin et al., "Gemtuzumab ozogamicin in acute myeloid leukemia.", *Leukemia*, 2017, pp. 1855-1868, vol. 31.
Griffin et al., "A monoclonal antibody reactive with normal and leukemic human myeloid progenitor cells.", *Leuk Res.*, 1984, pp. 521-534, vol. 8(4).
Henikoff & Henikoff, "Amino acid substitutions matrices from protein blocks.", *Proc. Natl. Acad. Sci. USA*, Nov. 1992, pp. 10915-10919, vol. 89.
Hope et al., "Acute myeloid leukemia originates from a hierarchy of leukemic stem cell classes that differ in self-renewal capacity.", *Nat. Immunol.*, 2004, pp. 738-743, vol. 5(7).
Karlin & Altschul, "Methods for assessing the statistical significance of molecular sequence features by using general scoring schemes.", *Proc. Nat'l. Acad. Sci. USA*, Mar. 1990, pp. 2264-2268, vol. 87.

Konno et al., "Fucose content of monoclonal antibodies can be controlled by culture medium osmolality for high antibody-dependent cellular cytotoxicity.", *Cytotechnology*, 2012, pp. 249-265, vol. 64.
Lamba et al., "CD33 Splicing Polymorphism Determines Gemtuzumab Ozogamicin Response in De Novo Acute Myeloid Leukemia: Report From Randomized Phase III Children's Oncology Group Trial AAML0531.", *J Clin Oncol*, Aug. 10, 2017, pp. 2674-2682, vol. 35(23).
Laszlo et al., "The past and future of CD33 as therapeutic target in acute myeloid leukemia.", *Blood Rev.*, 2014, pp. 143-153, vol. 28(4).
Makk et al., "Clinical Application of the Metabolic Cart to the Delivery of Total Parenteral Nutrition.", *Nutrition in Clinical Practice*, 2016, pp. 117, vol. 6(3).
Mori et al., "Engineering Chinese Hamster Ovary Cells to Maximize Effector Function of Produced Antibodies Using FUT8 siRNA.", *Biotechnol Bioeng*, 2004, pp. 901-908, vol. 88(7).
Needleman, S. & Wunsch, C., "A General Method Applicable to the Search for Similarities in the Amino Acid Sequence of Two Proteins.", *J. Mol. Biol.*, 1970, pp. 443-453, vol. 48.
Olivier et al., "EB66 cell line, a duck embryonic stem cell derived substrate for the industrial production of therapeutic monoclonal antibodies with enhanced ADCC activity.", *mAbs*, 2010. pp. 405-415, vol. 2(4.
Osborn, et al., "High-Affinity IgG Antibodies Develop Naturally in Ig-Knockout Rats Carrying Germline Human IgH/Igk/Igλ Loci Bearing the Rat CH Region.", *J. Immunol*, 2013, pp. 1481-1490, vol. 190(4).
Pearson et al., "Improved Tools for Biological Sequence Comparison.", *Proc. Nat'l. Acad. Sci.*, Apr. 1988, USA, pp. 2444-2448, vol. 85.
Perez-Oliva et al., "Epitope mapping, expression and post-translational modifications of two isoforms of CD33 (CD33M and CD33m) on lymphoid and myeloid human cells.", *Glycobiology*, 2011, pp. 757-770, vol. 21(6).
Salmeron et al., "A Conformational Epitope Expressed Upon Association of CD3-ε With Either CD3-σ or CD3-γ Is The Main Target for Recognition by Anti-CD3 Monoclonal Antibodies1*.", *J. Immunol.*, 1991, pp. 3047-3052, vol. 147(9).
Shields et al., "Lack of Fucose on Human IgG1 N-Linked Oligosaccharide Improves Binding to Human FcγRIII and Antibody-dependent Cellular Toxicity*", *J Biol Chem*, 2002, pp. 26733-26740, vol. 277(30).
Shinkawa et al., "The Absence of Fucose but Not the Presence of Galactose or Bisecting N-Acetylglucosamine of Human IgG1 Complex-type Oligosaccharides Shows the Critical Role of Enhancing Antibody-dependent Cellular Cytotoxicity*.", *J Biol Chem*, 2003, pp. 3466-3473, vol. 278(5).
Smith et al., "Comparison of Biosequences", *Adv. Appl. Math.*, 1981, pp. 482-489, vol. 2.
Zhou et al., "Development of A Simple and Rapid Method for Producing Non-Fucosylated Oligomannose Containing Antibodies With Increased Effector Function.", *Biotechnol Bioeng*, 2008, pp. 652-665, vol. 99.
Watanabe et al., "Distinct Distributions of Five N-Methyl-D-Aspartate Receptor Channel Subunit mRNAs in the Forebrain.", *J. Camp. Neural.*, 1993, pp. 377-390, vol. 338(3).
Weickert et al., "Molecular evidence of N-Methyl-D-Aspartate Receptor hypofunction in schizophrenia.", *Molecular Psychiatry*, 2013, pp. 1185-1192, vol. 18.
Won et al., "Autistic-like social behaviour in Shank2-mutant mice improved by restoring NMDA receptor function.", *Nature*, Jun. 14, 2012, pp. 261-265, vol. 486.
Wu, L.J. and Zhuo, M., "Targeting the NMDA Receptor Subunit NR2B for the Treatment of Neuropathic Pain.", *Neurotherapeutics*, Oct. 2009, pp. 693-702, vol. 6(4).
Yang et al., "Reduced brain infarct vol. and improved neurological outcome by inhibition of the NR2B subunit of NMDA receptors by using CP101,606-27 alone and in combination with rt-PA in a thromboembolic stroke model in rats.", *J. Neurosurg.*, 2003, pp. 397-403, vol. 98(2).

(56) References Cited

OTHER PUBLICATIONS

Yuan et al., "Context-Dependent GluN2B-Selective Inhibitors of NMDA Receptor Function Are Neuroprotective with Minimal Side Effects.", *Neuron*, Mar. 18, 2015; pp. 1305-1318, vol. 85(6).
Zarate et al., "A Randomized Trial of an N-methyl-D-aspartate Antagonist in Treatment-Resistant Major Depression.", *Arch. Gen. Psychiatry*, Aug. 2006, pp. 856-864, vol. 63(8).
Laszlo et al., "Cellular determinants for preclinical activity of a novel CD33/CD3 bispecific T-cell engager (BiTE) antibody, AMG330, against human AML.", Blood, Jan. 23, 2014, pp. 554-561, vol. 123(4).

\* cited by examiner

| Effective concentration (nM) | MOLM-13 | KG-1 | Kasumi-1 | OCI-AML3 |
|---|---|---|---|---|
| $EC_{20}$ | 0.0283 | 0.0525 | 0.0366 | 0.0844 |
| $EC_{50}$ | 0.1307 | 0.1677 | 0.0500 | 0.1826 |
| $EC_{90}$ | 2.2865 | 1.6978 | 0.0842 | 0.6220 |

| Effective concentration (nM) | MOLM-13 | KG-1 | Kasumi-1 | OCI-AML3 |
|---|---|---|---|---|
| $EC_{20}$ | 0.0077 | 0.0256 | 0.0267 | 0.0178 |
| $EC_{50}$ | 0.0283 | 0.0664 | 0.0432 | 0.0500 |
| $EC_{90}$ | 0.1677 | 0.4236 | 0.1126 | 0.2585 |

| Effective concentration (nM) | Median Cytotoxicity: MOLM-13 | Median T cell activation: MOLM-13 | Median Cytotoxicity: Kasumi-1 | Median T cell activation: Kasumi-1 |
|---|---|---|---|---|
| $EC_{20}$ | 0.017 | 0.054 | 0.039 | 0.060 |
| $EC_{50}$ | 0.037 | 0.111 | 0.085 | 0.124 |
| $EC_{90}$ | 0.132 | 0.420 | 0.281 | 0.496 |

→ C3CB189
⟶ nullxCD3

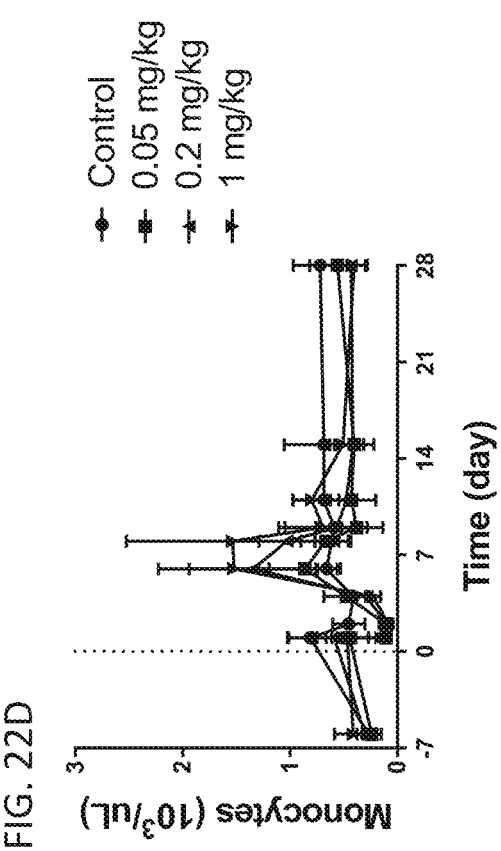
FIG. 22B
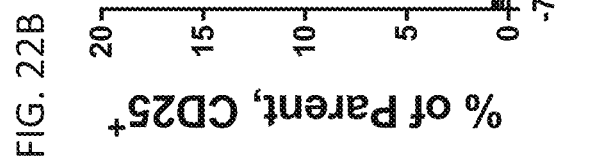
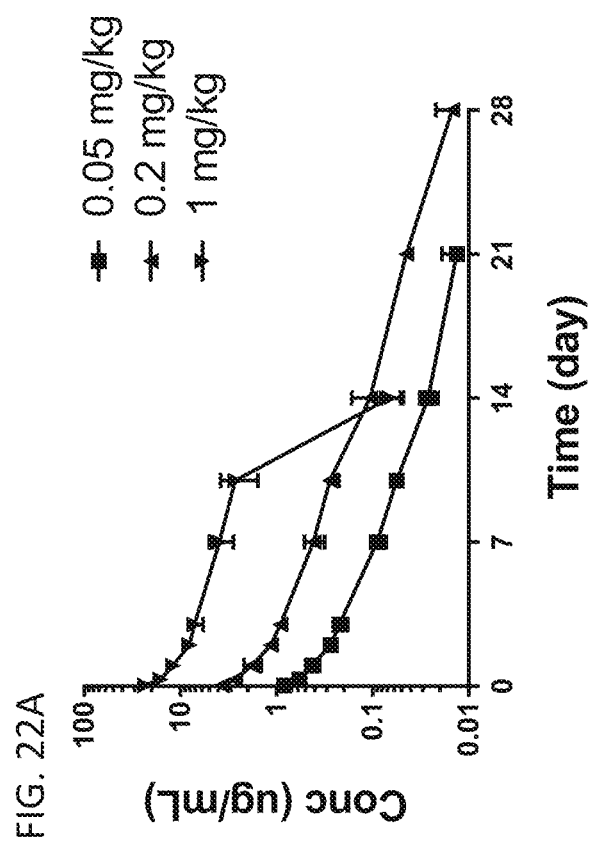
FIG. 22A
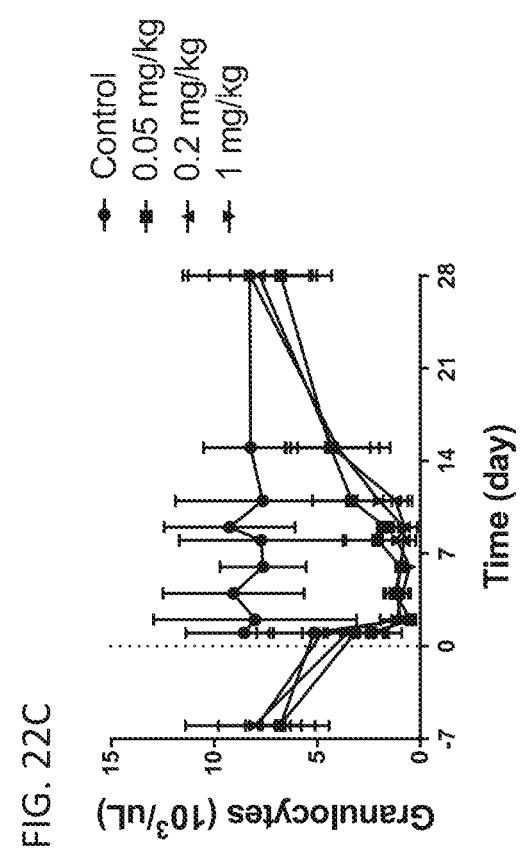

FIG. 25A

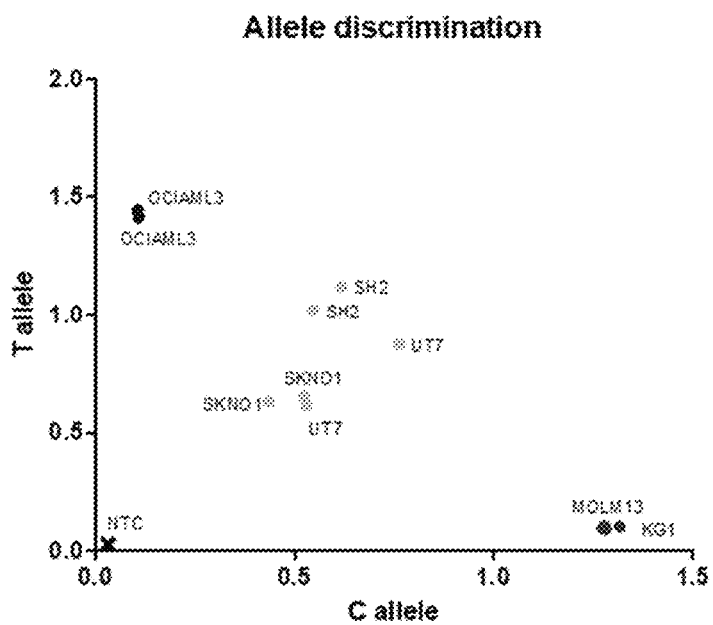

FIG. 25B

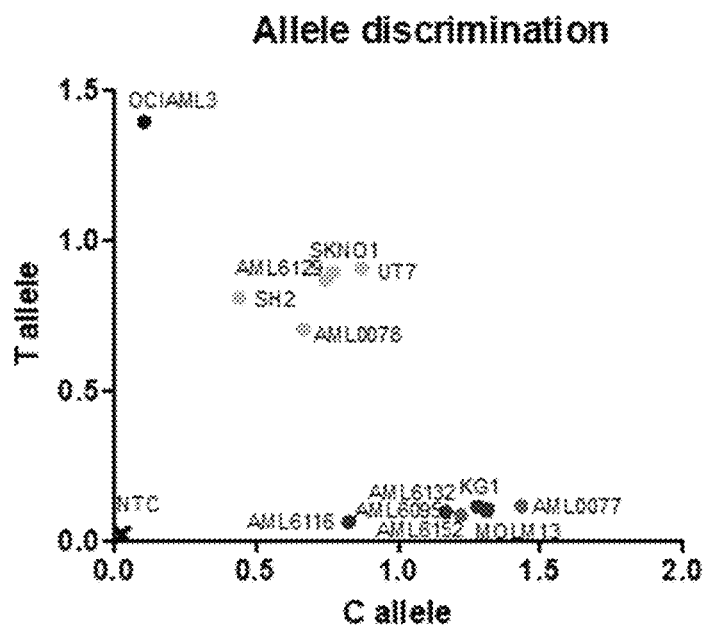

Legend
● Homozygous Allele 1/Allele 1    ● Homozygous Allele 2/Allele 2
● Heterozygous Allele 1/Allele 2    × Undetermined

FIG. 25C

| Sample ID | Rs12459419 (taqman) | Rs12459419 (sanger) |
|---|---|---|
| D1 | C/C | C\|C |
| D2 | C/T | C\|T |
| D3 | T/T | T\|T |
| D4 | C/C | C\|C |
| D5 | C/C | C\|C |
| D6 | C/C | C\|C |
| D7 | C/T | C\|T |
| D8 | T/T | T\|T |
| D9 | C/C | C\|C |
| D11 | C/T | C\|T |
| D12 | C/T | C\|T |
| D13 | C/T | C\|T |
| D14 | C/T | C\|T |
| D17 | C/T | C\|T |
| D18 | C/C | C\|C |
| D20 | T/T | T\|T |
| D21 | C/T | C\|T |
| D22 | T/T | T\|T |
| D23 | C/C | C\|C |
| D24 | C/T | C\|T |
| D25 | C/C | C\|C |
| D26 | C/C | C\|C |
| D28 | T/T | T\|T |
| D29 | C/T | C\|T |
| D30 | C/C | C\|C |
| | | |
| Totals: | C\|C; 10 | C\|C; 10 |
| | C\|T; 10 | C\|T; 10 |
| | T\|T; 5 | T\|T; 5 |

ANTI-CD33 ANTIBODIES, ANTI-CD33/ANTI-CD3 BISPECIFIC ANTIBODIES AND USES THEREOF

CROSS-REFERENCE TO RELATED APPLICATIONS

This application claims the benefit of U.S. Provisional Application Ser. No. 62/676,123, filed 24 May 2018 and U.S. Provisional Application Ser. No. 62/825,846, filed 29 Mar. 2019. The entire content of the aforementioned applications is incorporated herein by reference in its entirety.

FIELD OF THE INVENTION

This invention relates to monoclonal anti-CD33 antibodies, bispecific anti-CD33, anti-CD3 antibodies, nucleic acids and expression vectors encoding the antibodies, recombinant cells containing the vectors, and compositions comprising the antibodies. Methods of making the antibodies, and methods of using the antibodies to treat diseases including cancer, are also provided.

REFERENCE TO SEQUENCE LISTING SUBMITTED ELECTRONICALLY

This application contains a sequence listing, which is submitted electronically via EFS-Web as an ASCII formatted sequence listing with a file name "CD33_SL" and a creation date of Jul. 15, 2019, and having a size of 774 kb. The sequence listing submitted via EFS-Web is part of the specification and is herein incorporated by reference in its entirety.

BACKGROUND OF THE INVENTION

Acute myeloid leukemia (AML) is a genetically heterogeneous disease characterized by clonal expansion of leukemic cells. Despite an increased understanding of the underlying disease biology in AML, the standard treatment with cytotoxic chemotherapy has remained largely unchanged over the last decades and the overall five year survival remains poor, being <30% (Burnett, Wetzler, & Lowenberg, 2011; Cancer Genome Atlas Research et al., 2013) Hence, there is a pressing need for novel therapies with increased efficacy and decreased toxicity, ideally targeting the AML stem cells because these cells are believed to be critical in the pathogenesis of AML, and their inadequate eradication by standard therapy is thought to contribute to the high incidence of relapse (Hope, Jin, & Dick, 2004; Ishikawa et al., 2007). Although therapeutic antibodies directed at cell-surface molecules have proven effective for the treatment of malignant disorders such as lymphomas and acute lymphoblastic leukemia, as well as solid tumors (Hoelzer, 2013; Jackson & Chester, 2015), only one antibody-based therapy is currently approved for AML (Godwin, Gale, & Walter, 2017).

CD33 is a 67 kD single pass transmembrane glycoprotein and is a member of the sialic acid-binding immunoglobulin-like lectins (Siglecs) family. While its exact biological function is unclear, in normal individuals, it is primarily considered to be a myeloid differentiation antigen, with low expression in myeloid progenitors, neutrophils and macrophages while being highly expressed in circulating monocytes and dendritic cells. Importantly, CD33 has been detected on blasts and leukemic stem cells of 85-90% of patients presenting with AML. Interestingly, expression of CD33 is restricted to hematopoietic cells (Paul, Taylor, Stansbury, & McVicar, 2000; Ulyanova, Blasioli, Woodford-Thomas, & Thomas, 1999) but is absent on normal hematopoietic stem cells (Andrews, Torok-Storb, & Bernstein, 1983; Griffin, Linch, Sabbath, Larcom, & Schlossman, 1984; Jilani et al., 2002). These findings suggest that CD33 is a suitable target for an antibody-based therapy in AML.

The structure of CD33 consists of an amino-terminal V-set Ig-like domain (coded by exon 2 of CD33) that mediates sialic acid binding and a C2-set Ig-like domain (coded by exons 3 and 4) in its extracellular portion (Laszlo et al., 2016). Alternative splicing of CD33 RNA can lead to a shorter isoform that is expressed on the cell surface, which lacks the V- but retains the C2-set Ig-like domain (Laszlo, Estey, & Walter, 2014; Laszlo et al., 2016). The biological relevance of this splicing process was largely unknown until recent studies showed that a single nucleotide polymorphism (SNP) rs12459419 was present in ~50% of the AML population and leads to skipping of exon 2 of CD33 which results in the deletion of the V domain of CD33 (Lamba et al., 2017). Interestingly several CD33 antibody-based therapies, including MYLOTARG™ the only approved antibody for AML, binds and recognizes the V domain of CD33. The above mentioned study in fact showed that MYLOTARG™ has no efficacy in patients that express the SNP and therefore only had efficacy in ~50% of the AML population (Lamba et al., 2017). Given the data with MYLOTARG™, it is reasonable to hypothesize that the other V binding CD33 antibodies will also only be efficacious in a limited pool of AML patients, specifically ones that do not have the SNP rs12459419 mutation.

Indeed when studying the CD33 clinical space, additional anti-CD33 antibodies include AMGEN's® AMG330 and AMG673, AMPHIVENA's™ AMV564, IMMUNOGEN's™ IMGN779, BOEHRINGER INGELHEIM's® B1836858, ACTINIUM PHARMA's™ Actimab and SEATTLE GENETICS's™ SGN33A. AMGEN's® AMG330 is a CD33×CD3 BiTE and has been reported to "recognize a linear epitope located in the V-set domain of CD33 with the core sequence IPYYDKN." (Friedrich et al., 2014). Given that AMG673 is the half life extension version of the CD33 BiTE, it is believed to bind the same epitope as the BiTE. AMPHIVENA's™ AMV564 is a tetravalent bispecific CD33/CD3 antibody and according to U.S. Pat. No. 9,803,029, the antibody binds to the V domain of CD33. IMMUNOGEN™ IMGN779 is a CD33 antibody (My9-6) conjugated to a DNA alkylating agent and according to FIG. 1 in U.S. Pat. No. 9,359,442, $^{125}$I-labeled My9-6 antibody competed with My9 antibody for binding to CD33-positive U-937 cells. The My9 antibody binds to the V domain of CD33 (Perez-Oliva et al., 2011). Together, the evidence suggests that IMGN779 binds to the V domain of CD33. BOEHRINGER INGELHEIM's® BI 836858 is an Fc-engineered anti-CD33 antibody which mediates NK cell mediated ADCC and binds to the V domain of CD33) (Vasu et al., 2016). Additionally, Vasu et al. show evidence for mapping lintuzumab (HuM195) to the V domain of CD33 along with Malik et al. and Perez-Oliva et al. (Malik et al., 2015; Perez-Oliva et al., 2011). The HuM195 antibody is currently in clinical trials conjugated to actinium by ACTINIUM PHARMA™ to make Actimab. The HuM195 antibody has also been conjugated to a DNA binding agent by SEATTLE GENETICS™ to make SGN33A; however this drug is currently on hold because of toxicity concerns. Accordingly, the anti-CD33 antibodies known in the art bind to the V domain of CD33.

Given these data, there is a critical unmet medical need when it comes to CD33 based antibody therapies in AML and the need for having an antibody that binds the C2 domain of CD33 for the treatment of CD33-expressing cancers.

BRIEF SUMMARY OF THE INVENTION

In one general aspect, the invention relates to isolated monoclonal antibodies or antigen-binding fragments thereof that bind CD33. In certain embodiments, the isolated monoclonal antibodies or antigen-binding fragments thereof bind the C2 domain of CD33. In certain embodiments, the isolated monoclonal antibodies or antigen-binding fragments thereof bind the V domain of CD33.

In another general aspect, the invention relates to isolated bispecific antibodies or antigen-binding fragments thereof that bind to CD33 and CD3. In certain embodiments, the bispecific antibodies or antigen-binding fragments thereof bind the C2 domain of CD33. In certain embodiments, the bispecific antibodies or antigen-binding fragments thereof bind the V region of CD33.

Provided are isolated monoclonal antibodies or antigen-binding fragments thereof that specifically bind the C2 domain of CD33. In certain embodiments, the isolated monoclonal antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequences of:

a. SEQ ID NOs:447, 448, 449, 567, 568, and 569, respectively;
b. SEQ ID NOs:444, 445, 446, 564, 565, and 566, respectively;
c. SEQ ID NOs:354, 355, 356, 477, 478, and 479, respectively;
d. SEQ ID NOs:378, 379, 380, 501, 502, and 503, respectively;
e. SEQ ID NOs:411, 412, 413, 531, 532, and 533, respectively;
f. SEQ ID NOs:348, 349, 350, 471, 472, and 473, respectively;
g. SEQ ID NOs:360, 361, 362, 483, 484, and 485, respectively;
h. SEQ ID NOs:363, 364, 365, 486, 487, and 488, respectively;
i. SEQ ID NOs:366, 367, 368, 489, 490, and 491, respectively;
j. SEQ ID NOs:369, 370, 371, 492, 493, and 494, respectively;
k. SEQ ID NOs:387, 388, 389, 492, 493, and 494, respectively;
l. SEQ ID NOs:402, 403, 404, 522, 523, and 524, respectively;
m. SEQ ID NOs:408, 409, 410, 528, 529, and 530, respectively;
n. SEQ ID NOs:423, 424, 425, 543, 544, and 545, respectively; or
o. SEQ ID NOs:426, 427, 428, 546, 547, and 548, respectively.

The antibody or antigen-binding fragment thereof can, for example, specifically bind to CD33, preferably human CD33.

In certain embodiments, the isolated monoclonal antibody or antigen-binding fragment thereof comprises a heavy chain variable region having a polypeptide sequence at least 95% identical to SEQ ID NO:292, 291, 261, 269, 280, 259, 263, 264, 265, 266, 272, 277, 279, 284, or 285, or a light chain variable region having a polypeptide sequence at least 95% identical to SEQ ID NO:332, 331, 302, 310, 320, 300, 304, 305, 306, 307, 317, 319, 324, or 325.

In certain embodiments, the isolated monoclonal antibody or antigen-binding fragment thereof comprises:

a. a heavy chain variable region having the polypeptide sequence of SEQ ID NO:292, and a light chain variable region having the polypeptide sequence of SEQ ID NO:332;
b. a heavy chain variable region having the polypeptide sequence of SEQ ID NO:291, and a light chain variable region having the polypeptide sequence of SEQ ID NO:331;
c. a heavy chain variable region having the polypeptide sequence of SEQ ID NO:261, and a light chain variable region having the polypeptide sequence of SEQ ID NO:302;
d. a heavy chain variable region having the polypeptide sequence of SEQ ID NO:269, and a light chain variable region having the polypeptide sequence of SEQ ID NO:310;
e. a heavy chain variable region having the polypeptide sequence of SEQ ID NO:280, and a light chain variable region having the polypeptide sequence of SEQ ID NO:322;
f. a heavy chain variable region having the polypeptide sequence of SEQ ID NO:259, and a light chain variable region having the polypeptide sequence of SEQ ID NO:300;
g. a heavy chain variable region having the polypeptide sequence of SEQ ID NO:263, and a light chain variable region having the polypeptide sequence of SEQ ID NO:304;
h. a heavy chain variable region having the polypeptide sequence of SEQ ID NO:264, and a light chain variable region having the polypeptide sequence of SEQ ID NO:305;
i. a heavy chain variable region having the polypeptide sequence of SEQ ID NO:265, and a light chain variable region having the polypeptide sequence of SEQ ID NO:306;
j. a heavy chain variable region having the polypeptide sequence of SEQ ID NO:266, and a light chain variable region having the polypeptide sequence of SEQ ID NO:307;
k. a heavy chain variable region having the polypeptide sequence of SEQ ID NO:272, and a light chain variable region having the polypeptide sequence of SEQ ID NO:307;
l. a heavy chain variable region having the polypeptide sequence of SEQ ID NO:277, and a light chain variable region having the polypeptide sequence of SEQ ID NO:317;
m. a heavy chain variable region having the polypeptide sequence of SEQ ID NO:279, and a light chain variable region having the polypeptide sequence of SEQ ID NO:319;
n. a heavy chain variable region having the polypeptide sequence of SEQ ID NO:284, and a light chain variable region having the polypeptide sequence of SEQ ID NO:324; or
o. a heavy chain variable region having the polypeptide sequence of SEQ ID NO:285, and a light chain variable region having the polypeptide sequence of SEQ ID NO:325.

In certain embodiments, the isolated monoclonal antibody or antigen-binding fragment thereof induces antibody-dependent cellular cytotoxicity (ADCC) in vitro with an $EC_{50}$ of less than about 2 nM. The antibody or antigen-binding fragment thereof can, for example, comprise an IgG1 low fucose backbone.

In certain embodiments, the isolated monoclonal antibody or antigen-binding fragment thereof binds CD33 with a dissociation constant (KD) of less than about $5\times10^{-9}$ M.

In certain embodiments, the isolated monoclonal antibody or antigen-binding fragment thereof binds CD33 and induces internalization with an $EC_{50}$ of less than about 2 nM.

In certain embodiments, the isolated monoclonal antibody or antigen-binding fragment thereof is conjugated to a therapeutic agent.

In certain embodiments, the isolated monoclonal antibody or antigen-binding fragment thereof is chimeric, partially humanized, or fully humanized.

Also provided herein are anti-CD33/anti-CD3 bispecific antibodies or antigen-binding fragments thereof comprising an anti-CD33 antibody or an antigen-binding fragment thereof and an anti-CD3 antibody or antigen-binding fragment thereof, wherein the anti-CD33 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
    a. SEQ ID NOs:447, 448, 449, 567, 568, and 569, respectively;
    b. SEQ ID NOs:444, 445, 446, 564, 565, and 566, respectively;
    c. SEQ ID NOs:354, 355, 356, 477, 478, and 479, respectively;
    d. SEQ ID NOs:378, 379, 380, 501, 502, and 503, respectively;
    e. SEQ ID NOs:411, 412, 413, 531, 532, and 533, respectively;
    f. SEQ ID NOs:348, 349, 350, 471, 472, and 473, respectively;
    g. SEQ ID NOs:360, 361, 362, 483, 484, and 485, respectively;
    h. SEQ ID NOs:363, 364, 365, 486, 487, and 488, respectively;
    i. SEQ ID NOs:366, 367, 368, 489, 490, and 491, respectively;
    j. SEQ ID NOs:369, 370, 371, 492, 493, and 494, respectively;
    k. SEQ ID NOs:387, 388, 389, 492, 493, and 494, respectively;
    l. SEQ ID NOs:402, 403, 404, 522, 523, and 524, respectively;
    m. SEQ ID NOs:408, 409, 410, 528, 529, and 530, respectively;
    n. SEQ ID NOs:423, 424, 425, 543, 544, and 545, respectively; or
    o. SEQ ID NOs:426, 427, 428, 546, 547, and 548, respectively;
and the anti-CD3 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
    1) SEQ ID NOs: 342, 343, 344, 465, 466, and 467, respectively; or
    2) SEQ ID NOs: 345, 346, 347, 468, 469, and 470, respectively.

In certain embodiments, the anti-CD33 antibody or antigen-binding fragment thereof comprises a heavy chain variable region having a polypeptide sequence at least 95% identical to SEQ ID NO:292, 291, 261, 269, 280, 259, 263, 264, 265, 266, 272, 277, 279, 284, or 285, or a light chain variable region having a polypeptide sequence at least 95% identical to SEQ ID NO:332, 331, 302, 310, 320, 300, 304, 305, 306, 307, 317, 319, 324, or 325; and the anti-CD3 antibody or antigen-binding fragment thereof comprises a heavy chain variable region having a polypeptide sequence at least 95% identical to SEQ ID NO:257 or 258, or a light chain variable region having a polypeptide sequence at least 95% identical to SEQ ID NO:298 or 299.

In certain embodiments, the anti-CD33/anti-CD3 bispecific antibody or antigen-binding fragment thereof comprises:
    a. a heavy chain variable region having the polypeptide sequence of SEQ ID NO:292, and a light chain variable region having the polypeptide sequence of SEQ ID NO:332; and a heavy chain variable region having the polypeptide sequence of SEQ ID NO:257, and a light chain variable region having a polypeptide sequence of SEQ ID NO:298,
    b. a heavy chain variable region having the polypeptide sequence of SEQ ID NO:291, and a light chain variable region having the polypeptide sequence of SEQ ID NO:331; and a heavy chain variable region having the polypeptide sequence of SEQ ID NO:257, and a light chain variable region having a polypeptide sequence of SEQ ID NO:298;
    c. a heavy chain variable region having the polypeptide sequence of SEQ ID NO:261, and a light chain variable region having the polypeptide sequence of SEQ ID NO:302; and a heavy chain variable region having the polypeptide sequence of SEQ ID NO:257, and a light chain variable region having a polypeptide sequence of SEQ ID NO:298;
    d. a heavy chain variable region having the polypeptide sequence of SEQ ID NO:269, and a light chain variable region having the polypeptide sequence of SEQ ID NO:310; and a heavy chain variable region having the polypeptide sequence of SEQ ID NO:257, and a light chain variable region having a polypeptide sequence of SEQ ID NO:298;
    e. a heavy chain variable region having the polypeptide sequence of SEQ ID NO:280, and a light chain variable region having the polypeptide sequence of SEQ ID NO:322; and a heavy chain variable region having the polypeptide sequence of SEQ ID NO:257, and a light chain variable region having a polypeptide sequence of SEQ ID NO:298;
    f. a heavy chain variable region having the polypeptide sequence of SEQ ID NO:259, and a light chain variable region having the polypeptide sequence of SEQ ID NO:300; and a heavy chain variable region having the polypeptide sequence of SEQ ID NO:257, and a light chain variable region having a polypeptide sequence of SEQ ID NO:298;
    g. a heavy chain variable region having the polypeptide sequence of SEQ ID NO:263, and a light chain variable region having the polypeptide sequence of SEQ ID NO:304; and a heavy chain variable region having the polypeptide sequence of SEQ ID NO:257, and a light chain variable region having a polypeptide sequence of SEQ ID NO:298;
    h. a heavy chain variable region having the polypeptide sequence of SEQ ID NO:264, and a light chain variable region having the polypeptide sequence of SEQ ID NO:305; and a heavy chain variable region having the polypeptide sequence of SEQ ID NO:257, and a light chain variable region having a polypeptide sequence of SEQ ID NO:298;
i. a heavy chain variable region having the polypeptide sequence of SEQ ID NO:265, and a light chain variable region having the polypeptide sequence of SEQ ID NO:306; and a heavy chain variable region having the polypeptide sequence of SEQ ID NO:257, and a light chain variable region having a polypeptide sequence of SEQ ID NO:298;
j. a heavy chain variable region having the polypeptide sequence of SEQ ID NO:266, and a light chain variable region having the polypeptide sequence of SEQ ID NO:307; and a heavy chain variable region having the polypeptide sequence of SEQ ID NO:257, and a light chain variable region having a polypeptide sequence of SEQ ID NO:298;
k. a heavy chain variable region having the polypeptide sequence of SEQ ID NO:272, and a light chain variable region having the polypeptide sequence of SEQ ID NO:307; and a heavy chain variable region having the polypeptide sequence of SEQ ID NO:257, and a light chain variable region having a polypeptide sequence of SEQ ID NO:298;
l. a heavy chain variable region having the polypeptide sequence of SEQ ID NO:277, and a light chain variable region having the polypeptide sequence of SEQ ID NO:317; and a heavy chain variable region having the polypeptide sequence of SEQ ID NO:257, and a light chain variable region having a polypeptide sequence of SEQ ID NO:298;
m. a heavy chain variable region having the polypeptide sequence of SEQ ID NO:279, and a light chain variable region having the polypeptide sequence of SEQ ID NO:319; and a heavy chain variable region having the polypeptide sequence of SEQ ID NO:257, and a light chain variable region having a polypeptide sequence of SEQ ID NO:298;
n. a heavy chain variable region having the polypeptide sequence of SEQ ID NO:284, and a light chain variable region having the polypeptide sequence of SEQ ID NO:324; and a heavy chain variable region having the polypeptide sequence of SEQ ID NO:257, and a light chain variable region having a polypeptide sequence of SEQ ID NO:298;
o. a heavy chain variable region having the polypeptide sequence of SEQ ID NO:285, and a light chain variable region having the polypeptide sequence of SEQ ID NO:325; and a heavy chain variable region having the polypeptide sequence of SEQ ID NO:257, and a light chain variable region having a polypeptide sequence of SEQ ID NO:298;
p. a heavy chain variable region having the polypeptide sequence of SEQ ID NO:292, and a light chain variable region having the polypeptide sequence of SEQ ID NO:332; and a heavy chain variable region having the polypeptide sequence of SEQ ID NO:258, and a light chain variable region having a polypeptide sequence of SEQ ID NO:299;
q. a heavy chain variable region having the polypeptide sequence of SEQ ID NO:291, and a light chain variable region having the polypeptide sequence of SEQ ID NO:331; and a heavy chain variable region having the polypeptide sequence of SEQ ID NO:258, and a light chain variable region having a polypeptide sequence of SEQ ID NO:299;
r. a heavy chain variable region having the polypeptide sequence of SEQ ID NO:261, and a light chain variable region having the polypeptide sequence of SEQ ID NO:302; and a heavy chain variable region having the polypeptide sequence of SEQ ID NO:258, and a light chain variable region having a polypeptide sequence of SEQ ID NO:299;
s. a heavy chain variable region having the polypeptide sequence of SEQ ID NO:269, and a light chain variable region having the polypeptide sequence of SEQ ID NO:310; and a heavy chain variable region having the polypeptide sequence of SEQ ID NO:258, and a light chain variable region having a polypeptide sequence of SEQ ID NO:299;
t. a heavy chain variable region having the polypeptide sequence of SEQ ID NO:280, and a light chain variable region having the polypeptide sequence of SEQ ID NO:322; and a heavy chain variable region having the polypeptide sequence of SEQ ID NO:258, and a light chain variable region having a polypeptide sequence of SEQ ID NO:299;
u. a heavy chain variable region having the polypeptide sequence of SEQ ID NO:259, and a light chain variable region having the polypeptide sequence of SEQ ID NO:300; and a heavy chain variable region having the polypeptide sequence of SEQ ID NO:258, and a light chain variable region having a polypeptide sequence of SEQ ID NO:299;
v. a heavy chain variable region having the polypeptide sequence of SEQ ID NO:263, and a light chain variable region having the polypeptide sequence of SEQ ID NO:304; and a heavy chain variable region having the polypeptide sequence of SEQ ID NO:258, and a light chain variable region having a polypeptide sequence of SEQ ID NO:299;
w. a heavy chain variable region having the polypeptide sequence of SEQ ID NO:264, and a light chain variable region having the polypeptide sequence of SEQ ID NO:305; and a heavy chain variable region having the polypeptide sequence of SEQ ID NO:258, and a light chain variable region having a polypeptide sequence of SEQ ID NO:299;
x. a heavy chain variable region having the polypeptide sequence of SEQ ID NO:265, and a light chain variable region having the polypeptide sequence of SEQ ID NO:306; and a heavy chain variable region having the polypeptide sequence of SEQ ID NO:258, and a light chain variable region having a polypeptide sequence of SEQ ID NO:299;
y. a heavy chain variable region having the polypeptide sequence of SEQ ID NO:266, and a light chain variable region having the polypeptide sequence of SEQ ID NO:307; and a heavy chain variable region having the polypeptide sequence of SEQ ID NO:258, and a light chain variable region having a polypeptide sequence of SEQ ID NO:299;
z. a heavy chain variable region having the polypeptide sequence of SEQ ID NO:272, and a light chain variable region having the polypeptide sequence of SEQ ID NO:307; and a heavy chain variable region having the polypeptide sequence of SEQ ID NO:258, and a light chain variable region having a polypeptide sequence of SEQ ID NO:299;

aa. a heavy chain variable region having the polypeptide sequence of SEQ ID NO:277, and a light chain variable region having the polypeptide sequence of SEQ ID NO:317; and a heavy chain variable region having the polypeptide sequence of SEQ ID NO:258, and a light chain variable region having a polypeptide sequence of SEQ ID NO:299;

bb. a heavy chain variable region having the polypeptide sequence of SEQ ID NO:279, and a light chain variable region having the polypeptide sequence of SEQ ID NO:319; and a heavy chain variable region having the polypeptide sequence of SEQ ID NO:258, and a light chain variable region having a polypeptide sequence of SEQ ID NO:299;

cc. a heavy chain variable region having the polypeptide sequence of SEQ ID NO:284, and a light chain variable region having the polypeptide sequence of SEQ ID NO:324; and a heavy chain variable region having the polypeptide sequence of SEQ ID NO:258, and a light chain variable region having a polypeptide sequence of SEQ ID NO:299; or dd. a heavy chain variable region having the polypeptide sequence of SEQ ID NO:285, and a light chain variable region having the polypeptide sequence of SEQ ID NO:325; and a heavy chain variable region having the polypeptide sequence of SEQ ID NO:258, and a light chain variable region having a polypeptide sequence of SEQ ID NO:299.

In certain embodiments, the anti-CD33/anti-CD3 bispecific antibodies or antigen-binding fragments thereof induces T-cell dependent cytotoxicity in CD33-expressing cells in vitro with an $EC_{50}$ value of less than about 1 nM.

In certain embodiments, anti-CD33/anti-CD3 bispecific antibodies or antigen-binding fragments thereof is chimeric, partially humanized, or fully humanized.

Also provided are isolated nucleic acids encoding the monoclonal and/or bispecific antibodies or antigen-binding fragments thereof of the invention.

Also provided are vectors comprising the isolated nucleic acids encoding the monoclonal and/or bispecific antibodies or antigen-binding fragments thereof of the invention.

Also provided are host cells comprising the vectors comprising the isolated nucleic acids encoding the monoclonal and/or bispecific antibodies or antigen-binding fragments thereof of the invention.

In certain embodiments, provided is a pharmaceutical composition comprising the isolated monoclonal antibody or antigen-binding fragment thereof of the invention and a pharmaceutically acceptable carrier. In certain embodiments, provided is a pharmaceutical composition comprising the isolated bispecific antibody or antigen-binding fragment thereof of the invention and a pharmaceutically acceptable carrier.

Also provided are methods of treating cancer in a subject in need thereof, comprising administering to the subject the pharmaceutical compositions of the invention. In certain embodiments, the cancer is a hematologic cancer. The hematologic cancer can, for example, be selected from, but not limited to, the group consisting of a leukemia, a lymphoma, or a multiple myeloma. In certain embodiments, the hematologic cancer can be acute myeloid leukemia (AML), myelodysplastic syndrome (MDS, low or high risk), acute lymphocytic leukemia (ALL, including all subtypes), diffuse large B-cell lymphoma (DLBCL), chronic myeloid leukemia (CML), or blastic plasmacytoid dendritic cell neoplasm (DPDCN).

Also provided are methods of producing the monoclonal or bispecific antibody or antigen-binding fragment thereof of the invention. The methods comprise culturing a cell comprising a nucleic acid encoding the monoclonal or bispecific antibody or antigen-binding fragment under conditions to produce the monoclonal or bispecific antibody or antigen-binding fragment, and recovering the monoclonal or bispecific antibody or antigen-binding fragment from the cell or culture.

Also provided are methods of producing a pharmaceutical composition comprising the monoclonal and/or bispecific antibody or antigen-binding fragment of the invention. The methods comprise combining the monoclonal and/or bispecific antibody or antigen-binding fragment thereof with a pharmaceutically acceptable carrier to obtain the pharmaceutical composition.

BRIEF DESCRIPTION OF THE DRAWINGS

The foregoing summary, as well as the following detailed description of preferred embodiments of the present application, will be better understood when read in conjunction with the appended drawings. It should be understood, however, that the application is not limited to the precise embodiments shown in the drawings.

FIG. 1A shows antibody candidates identified by OMNIRAT® and FIG. 1B shows antibody candidates identified by OMNIMOUSE®.

FIG. 2A shows the percent of total cell cytotoxicity of AML cells using CD33 bispecific antibodies or the CD3×null controls. FIG. 2B shows T cell activation induced by CD33 bispecific antibodies or the CD3×null controls. No Fc blocker was added.

FIG. 5A shows the percent of total cell cytotoxicity of CD33$^+$CD14$^+$ cyno monocytes using CD33 bispecific antibodies or their CD3×null controls. FIG. 5B shows T cell activation induced by CD33 bispecific antibodies or their CD3×null controls. No Fc blocker was added.

Disseminated MOLM-13 tumors were imaged for bioluminescence (BLI) twice weekly and the results presented as average radiance (p/s/cm$^2$/sr)±SEM (n=8-10/group). *p≤0.0001 for treatment vs. control, calculated by two-way ANOVA with Bonferroni test.

Figure 7:
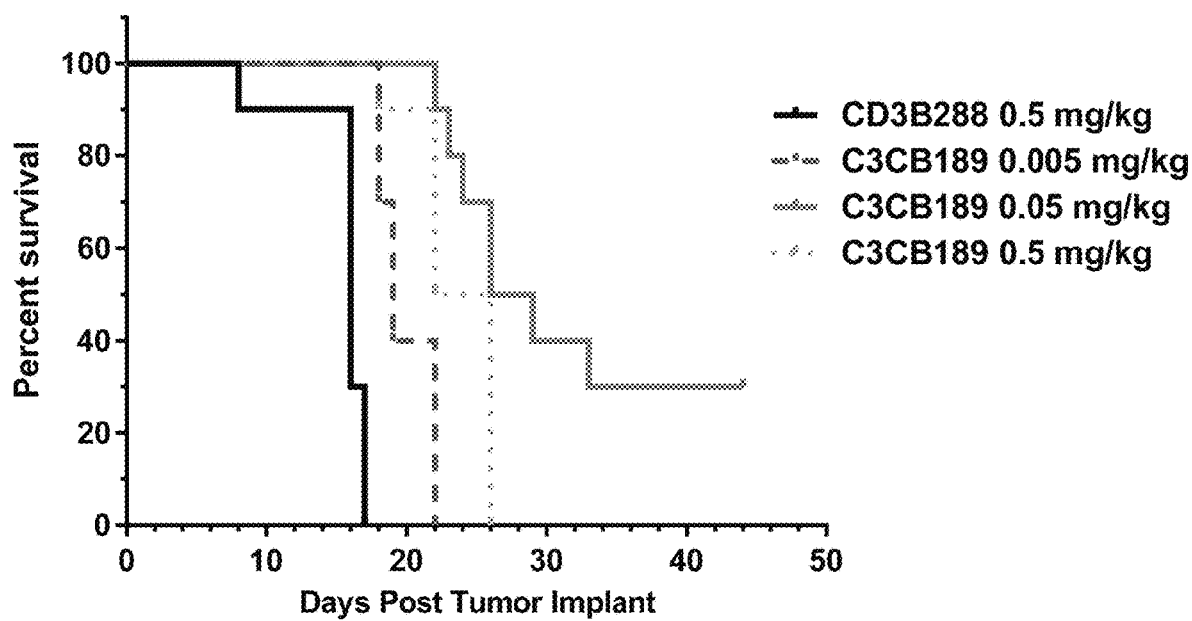

FIG. 7 shows survival of animals treated with C3CB189 in MOLM-13 Human AML xenografts in T cell humanized NSG mice. Survival of MOLM-13 bearing mice is graphically represented using a Kaplan-Meier curve and evaluated by Log-rank (Mantel-Cox) test. *p≤0.0001 for treatment vs. control groups.

Figure 8:
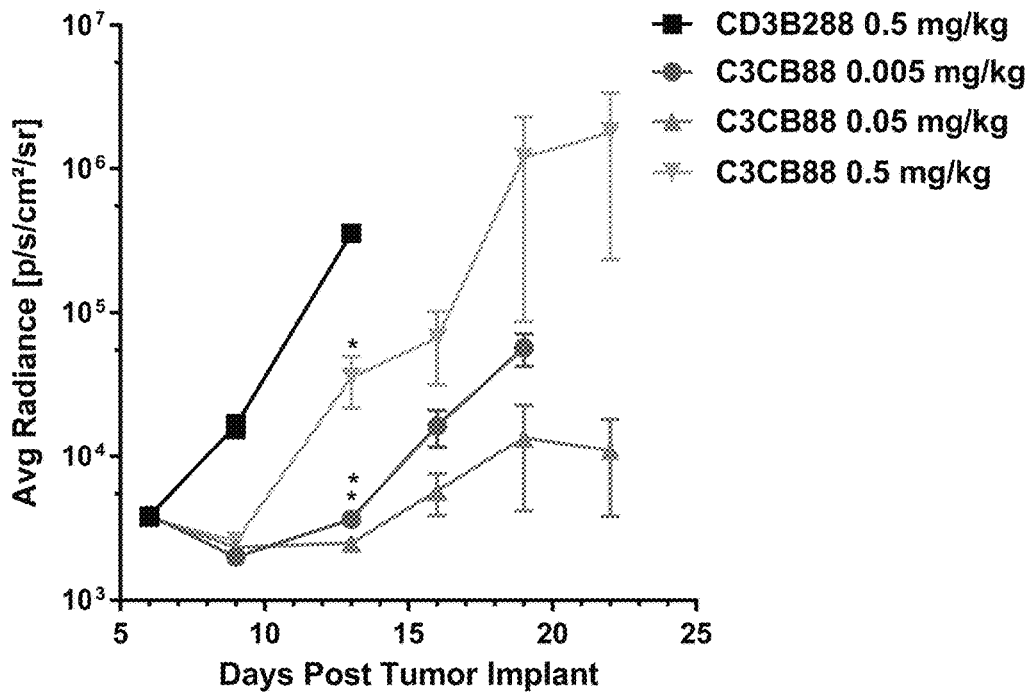

FIG. 8 shows anti-tumor efficacy of C3CB88 in MOLM-13 human AML xenografts in T cell humanized NSG mice. Disseminated MOLM-13 tumors were imaged for bioluminescence (BLI) twice weekly and the results presented as average radiance (p/s/cm$^2$/sr)±SEM (n=8-10/group). *p≤0.0001 for treatment vs. control, calculated by two-way ANOVA with Bonferroni test.

Figure 9:
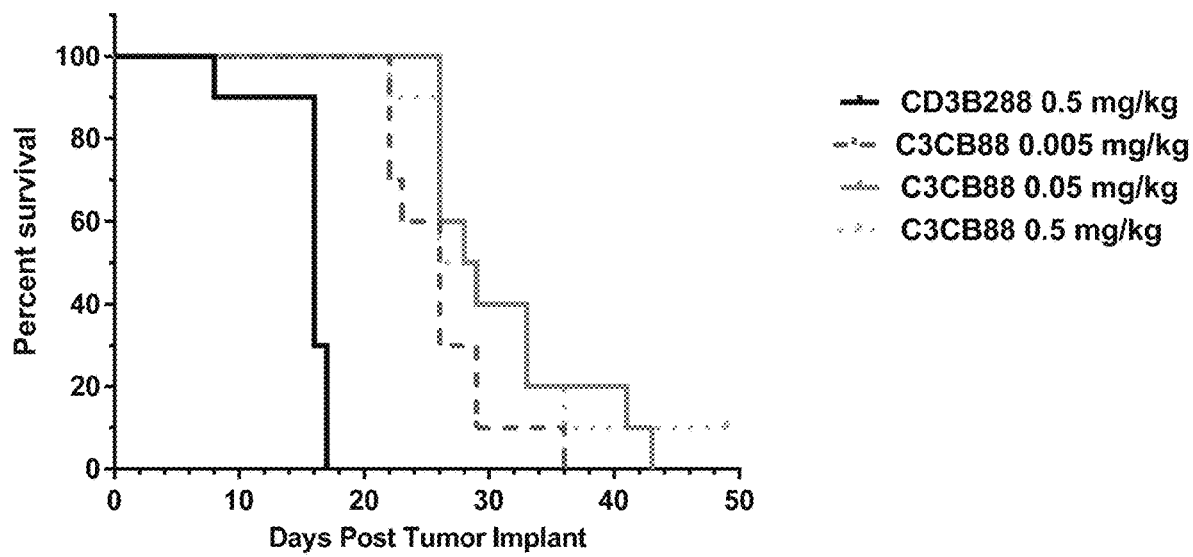

FIG. 9 shows survival of animals treated with C3CB88 in MOLM-13 human AML xenografts in T cell humanized NSG mice. Survival of MOLM-13 bearing mice is graphically represented using a Kaplan-Meier curve and evaluated by Log-rank (Mantel-Cox) test. *p≤0.05 for treatment vs. control groups.

Figure 10:
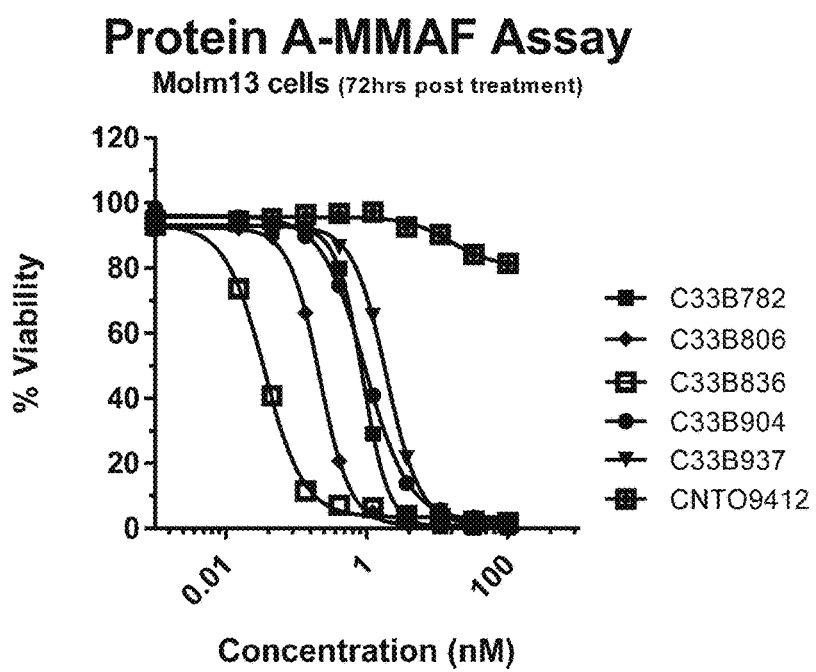

FIG. 10 shows in vitro protein A drug conjugate cell viability assay for detection of five anti-CD33 antibodies internalization in MOLM13 cells. All five anti-CD33 antibodies showed cytotoxicity in a dose dependent manner.

Figure 11A:
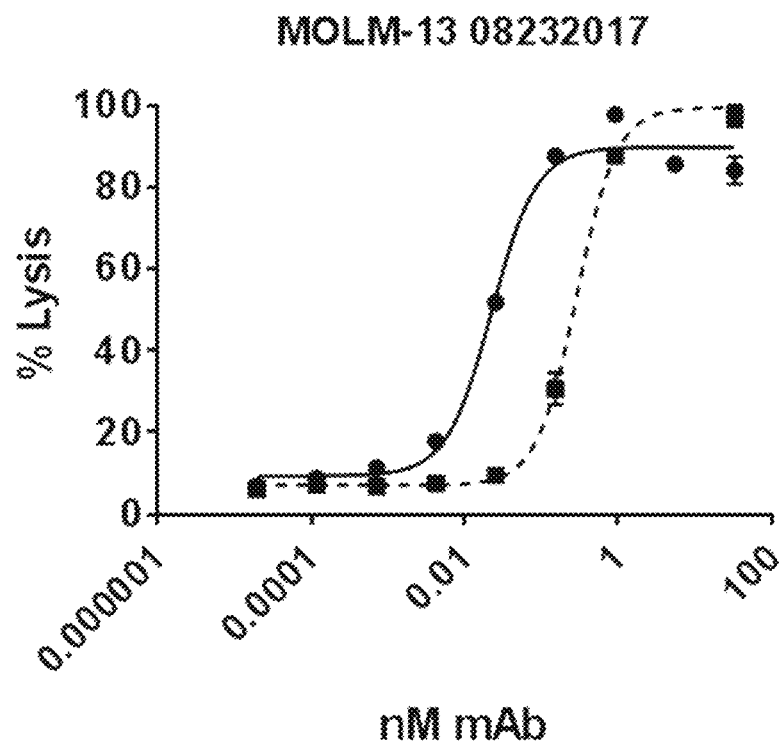
Figure 11B:
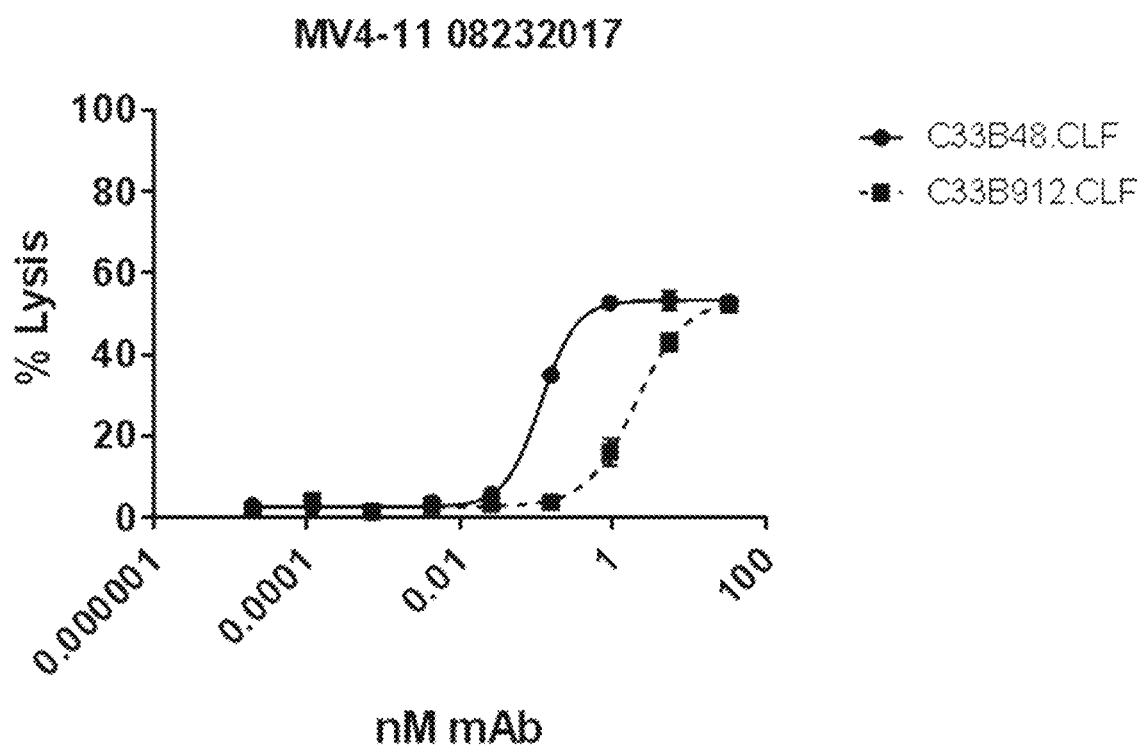

FIGS. 11A-11B show low fucose IgG1 anti-CD33 mAbs mediate ADCC activity. ADCC of human NK cells against MOLM-13 (FIG. 11A) and MV4-11 (FIG. 11B) target cells in response to increasing concentrations of IgG1 anti-CD33 mAbs.

Figure 12:
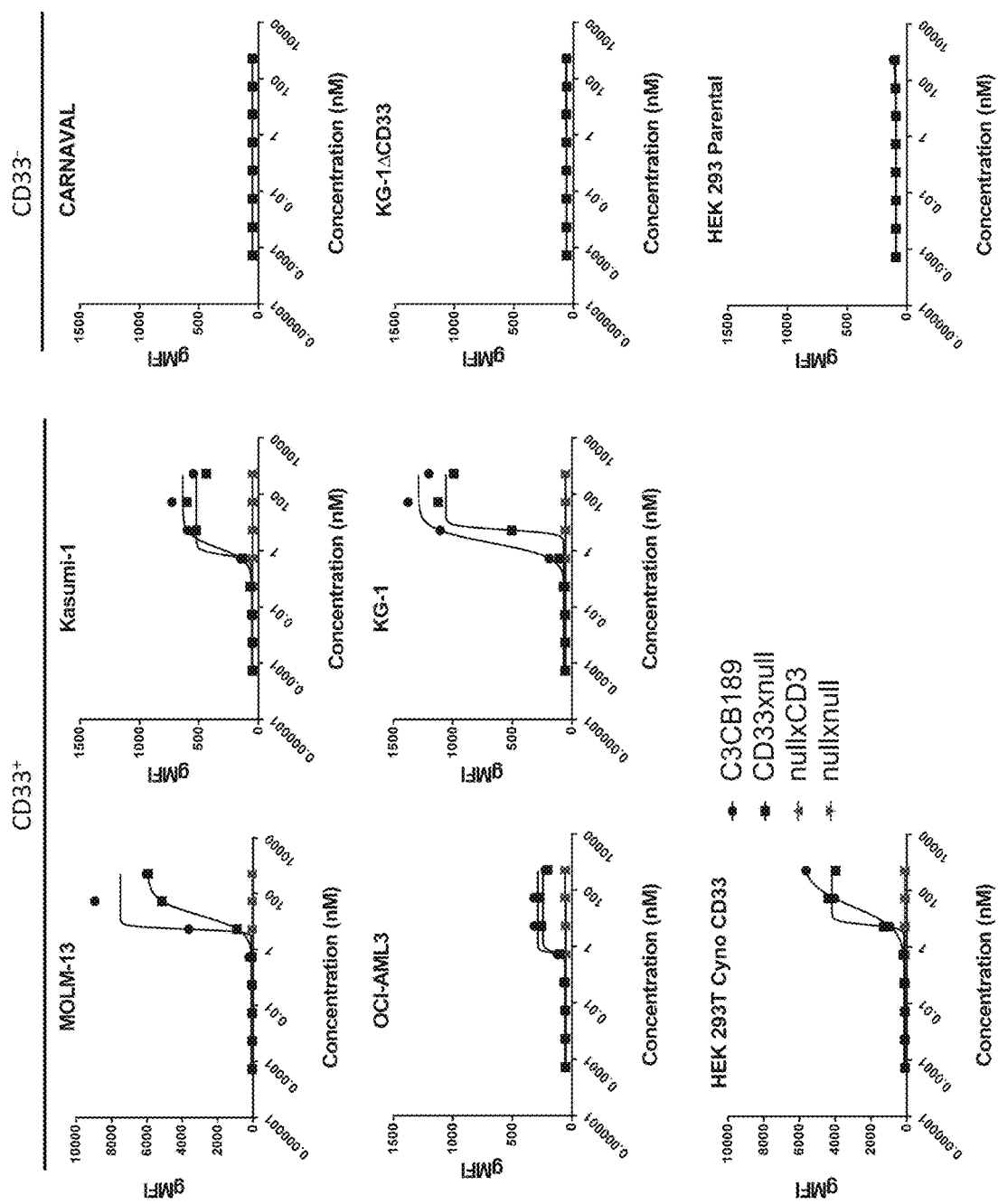

FIG. 12 shows CD33-positive and CD33-negative cell lines were stained for 4 h with various concentrations of C3CB189 to characterize the surface binding profiles of the bispecific antibody.

Figure 13:
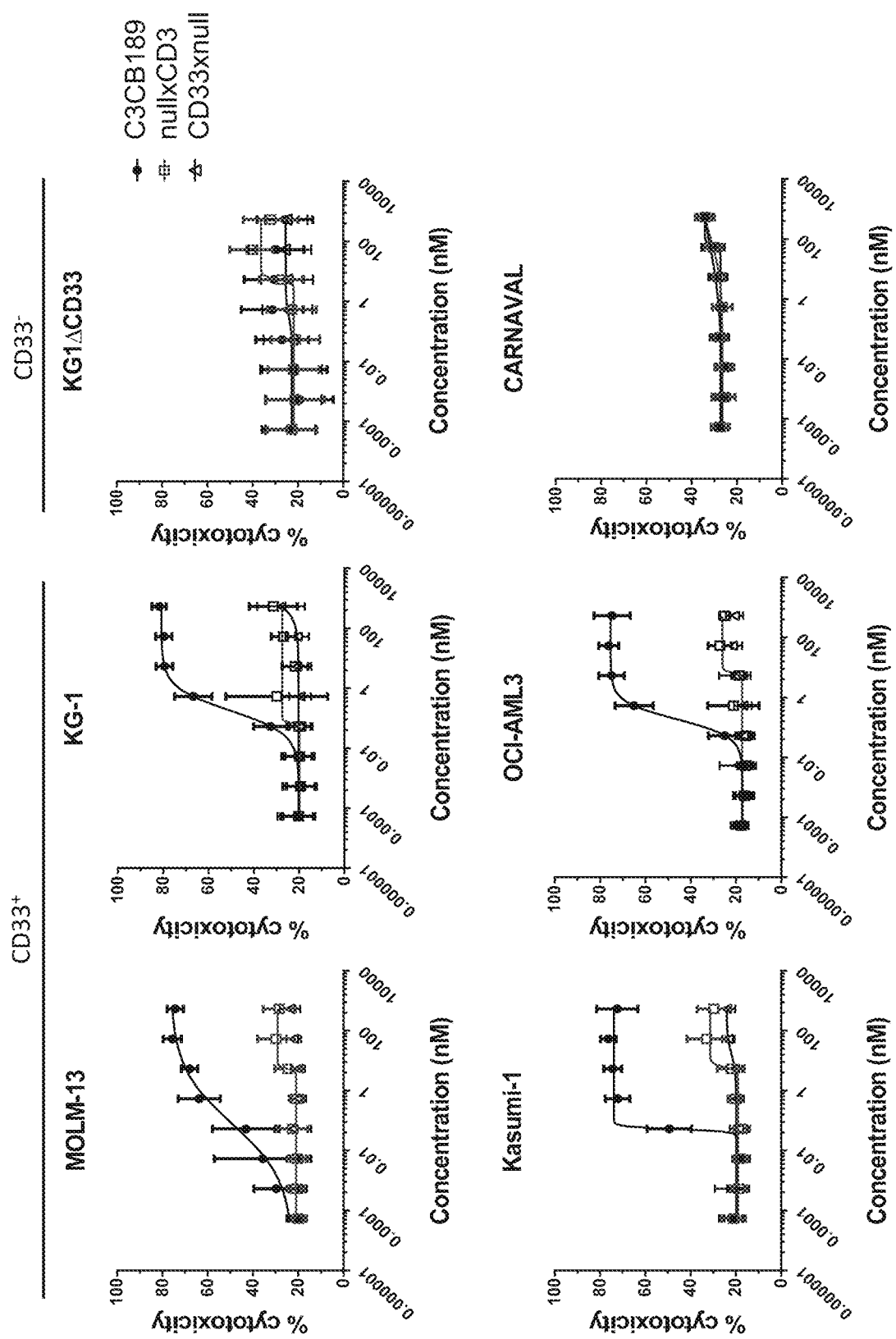

FIG. 13 shows T cells from six healthy donors were tested in T cell redirection assays with the indicated cell lines and percentage of cytotoxicity was determined by FACS. Mean±SD is graphed.

Figure 14A:
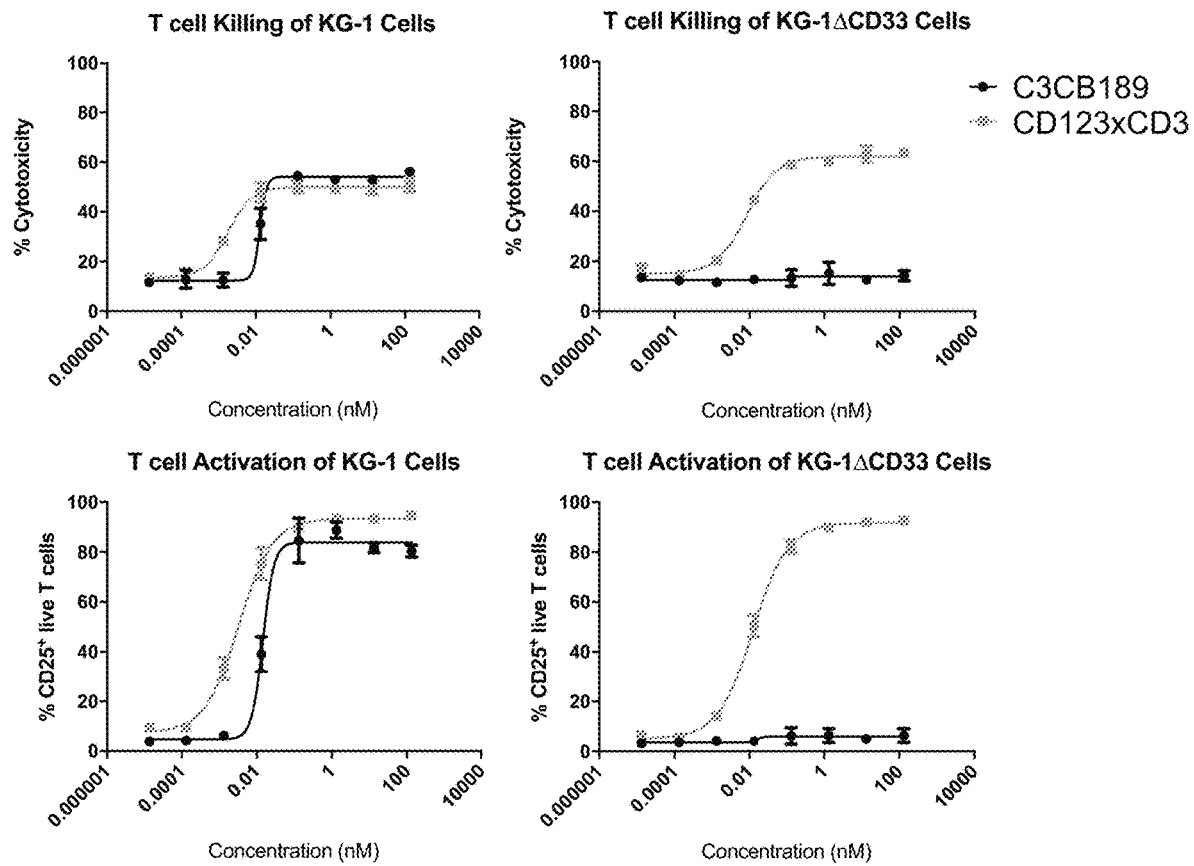
Figure 14B:
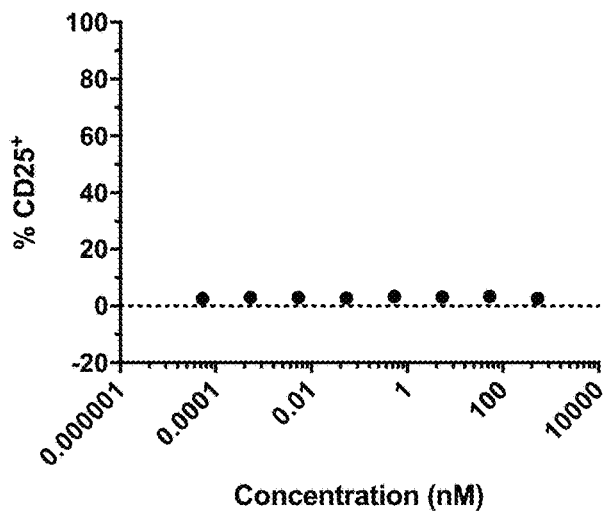

FIGS. 14A and 14B. C3CB189 binds to the C2 domain and mediates cytotoxicity of primary samples regardless of their SNP 12459419 genotype status. FIG. 14A) T cell-mediated cytotoxicity and activation assays using CD33× CD3 or CD123×CD3 bispecific antibodies in CD33$^+$KG-1 and CD33-KG1ΔCD33 cell lines. FIG. 14B) T cells alone were incubated with increasing concentrations of C3CB189 for 48 hours and T cell activation was measured by flow cytometry. Mean±SD is graphed.

Figures 15A, 15B, 15C:
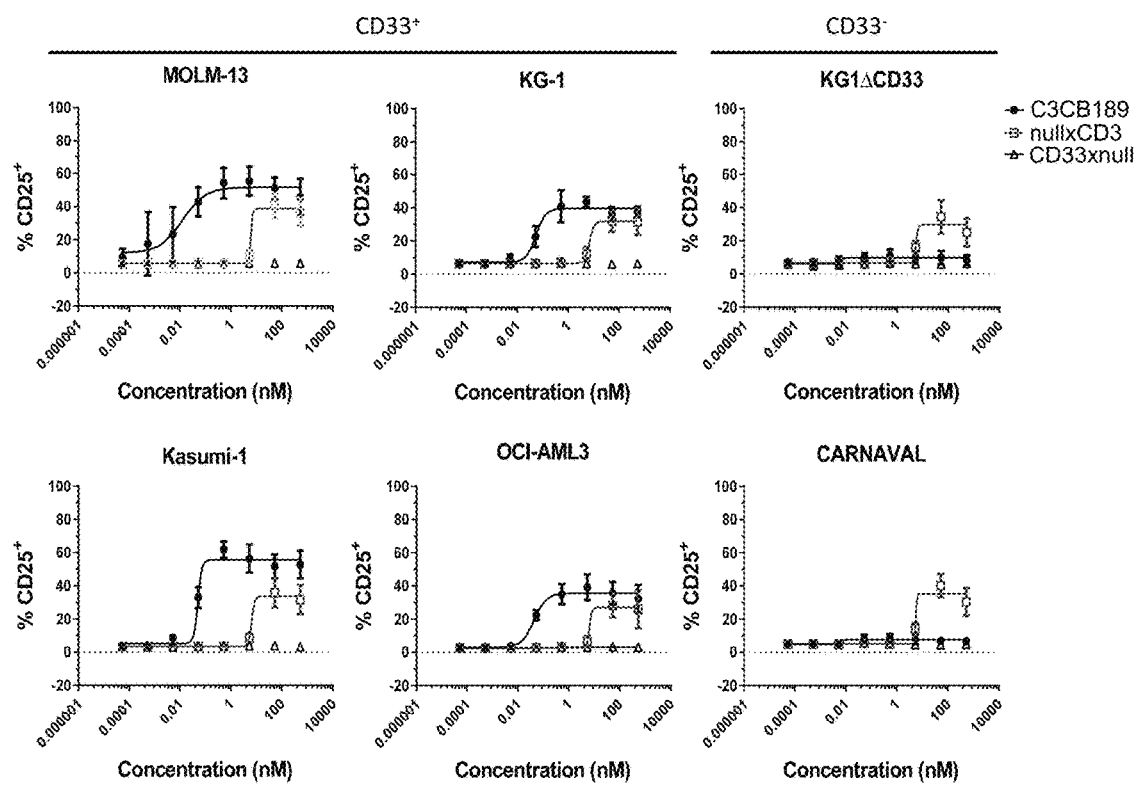

FIGS. 15A-15C. FIG. 15A shows Median values showing EC$_{20}$, EC$_{50}$ and EC$_{90}$ for the cytotoxicity readout from six healthy donors. FIG. 15B is similar to FIG. 13 but here T cell activation was measured. FIG. 15C is Similar to FIG. 15A but here median EC$_{20}$, EC$_{50}$ and EC$_{90}$ values are shown for the T cell activation readout from six healthy donors.

Figure 16A:
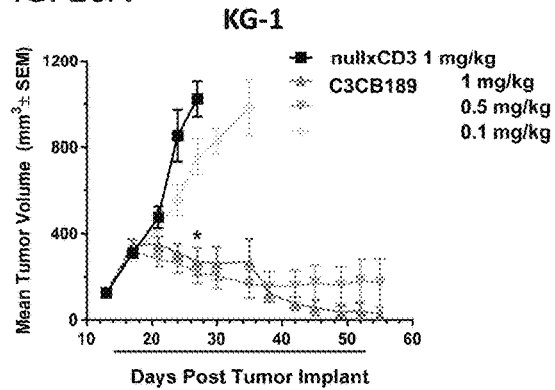
Figure 16B:
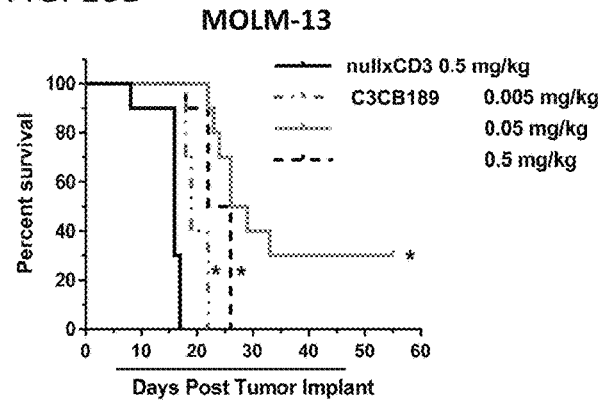
Figure 16C:
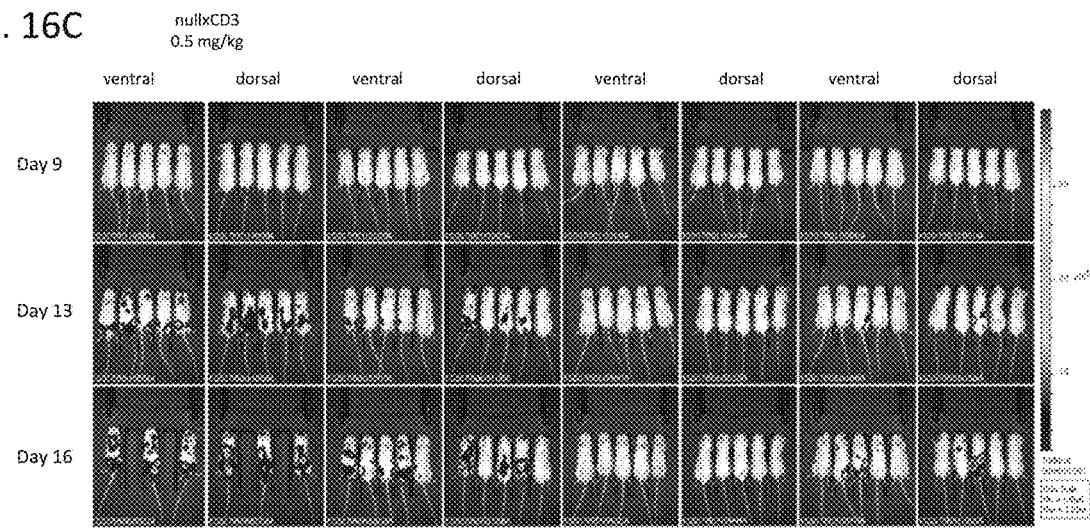
Figure 16D:
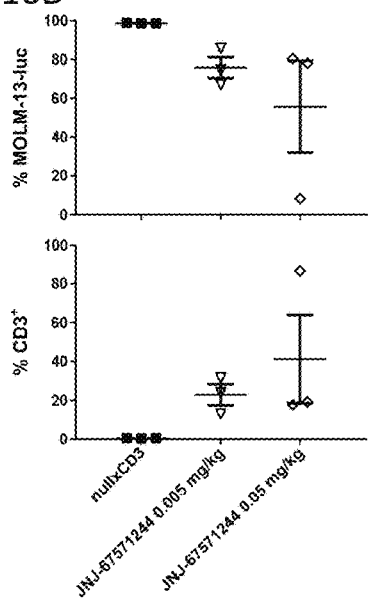
Figure 16E:
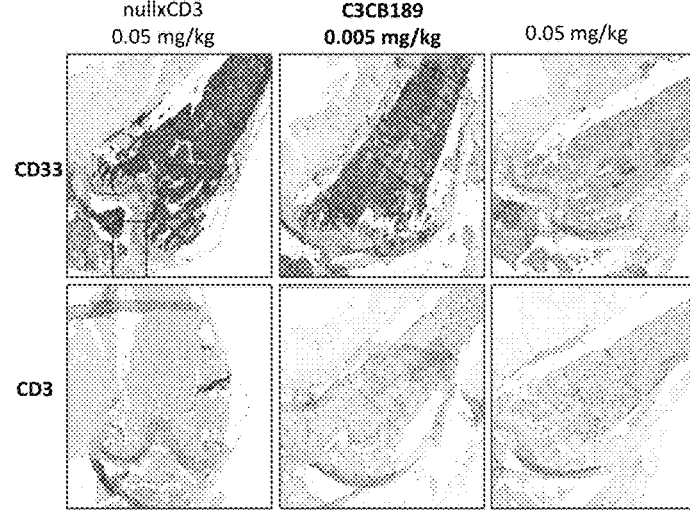

FIGS. 16A-16E: C3CB189 mediates potent tumor activity in vivo in two established murine AML models. FIG. 16A shows T cell-humanized NSG mice bearing established KG-1 tumors were i.p. dosed with C3CB189 at 0.1, 0.5, and 1 mg/kg. Tumor volume was measured twice weekly and the results presented as the mean tumor volume ±SEM for each group. FIG. 16B shows T cell-humanized NSG mice bearing disseminated MOLM-13Luc cells were i.p. dosed with C3CB189 at 0.005, 0.05, and 0.5 mg/kg. Survival was determined utilizing Kaplan Meier survival analysis. FIG. 16C is the same as FIG. 16B but here bioluminescence was measured twice weekly and representative images of live animal imaging of bioluminescence (ventral and dorsal views of n=3-5 animals) on Days 9, 13, and 16 are shown (n=3 in control group on Day 16 due to mortality). FIG. 16D is similar to FIG. 16B but here mice were dosed with C3CB189 at 0.005 and 0.05 mg/kg for three doses. T cell infiltration in the bone marrow was measured by flow cytometric analysis and results are presented as percentage tumor cells (top panel) or percentage CD3$^+$ T cells (bottom panel). FIG. 16E is the same as FIG. 16D but here T cell infiltration in bone marrow was measured by IHC staining and results are presented as CD33$^+$ tumor cells (top panel) or CD8$^+$ T cells (bottom panel).

Figure 17:
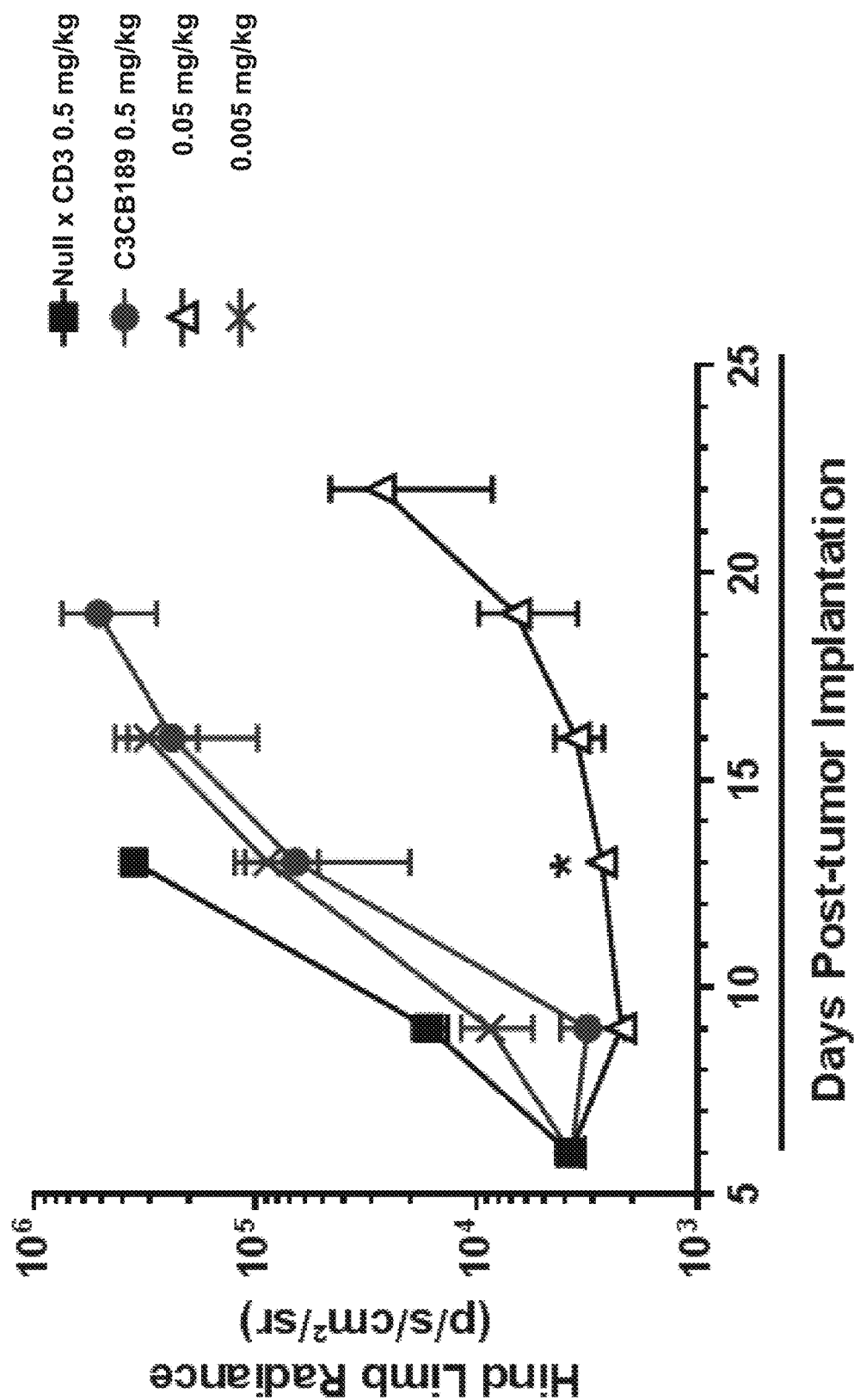

FIG. 17 shows that C3CB189 mediates anti-tumor responses in a disseminated murine AML model. Tumor cells were implanted on Day 0, T cells were implanted on Day 5, and dosing occurred as denoted by bar below the X axis. Group bioluminescence is graphed as the mean±SEM. * denotes significant difference on Day 13 (p≤0.05) between treatment with C3CB189 and null×CD3 control (n=9-10/group on Day 13).

Figures 18A, 18B:
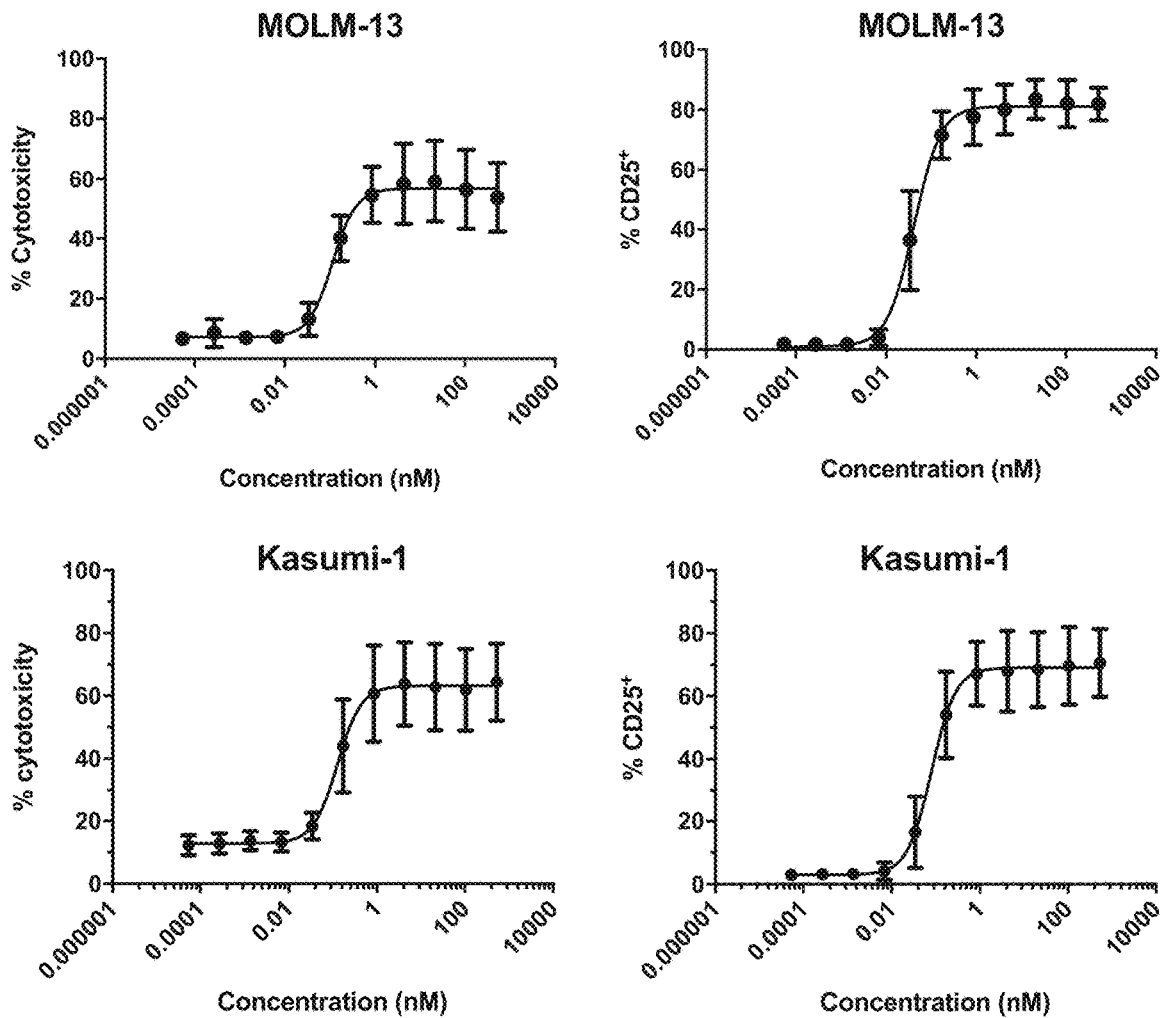

FIGS. 18A and 18B show C3CB189 Induced T Cell-Dependent Cytotoxicity of CD33$^+$ Cell Lines in Whole Blood. FIG. 18A show T cells from ten healthy donors (single point per donor) were tested in T cell redirection assays with the indicated cell lines. Mean±SD is graphed. FIG. 18B is the same as FIG. 18A but here cytotoxicity and T cell activation EC$_{20}$, EC$_{50}$ and EC$_{90}$ values are shown. ND indicates could not be determined, ie, Prism either provided an approximated value or the curve was ambiguous. Values are medians from 10 healthy donors.

Figure 19A:
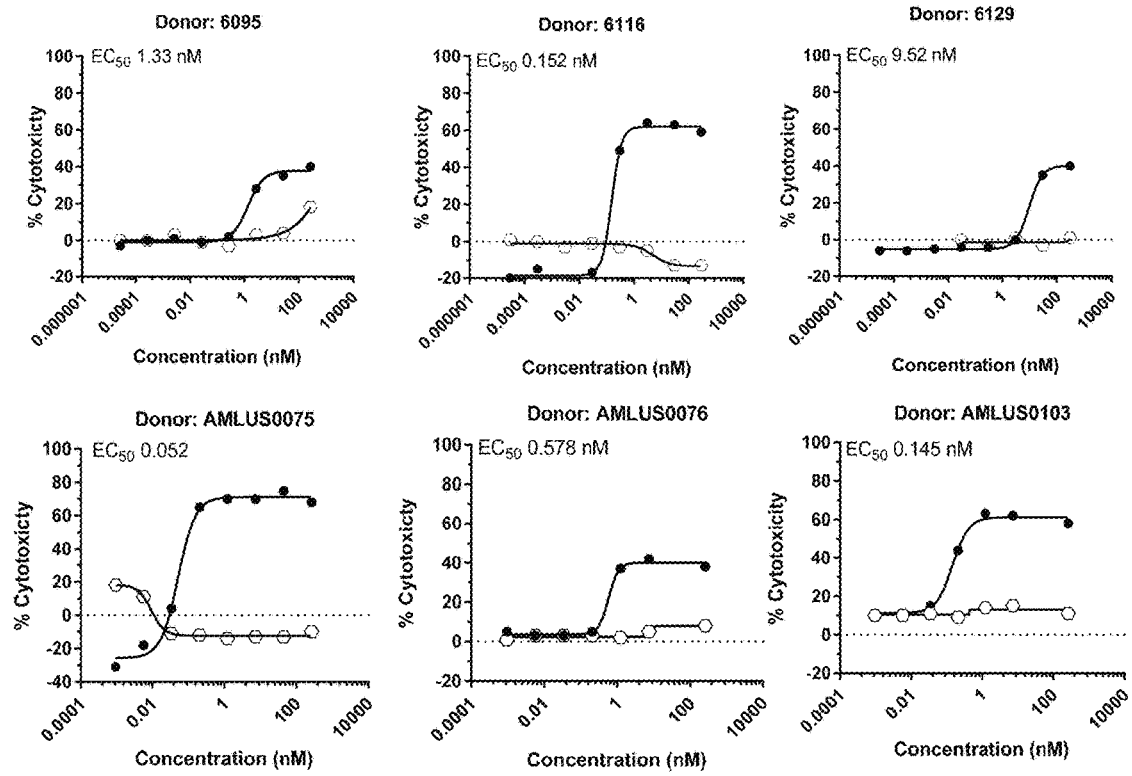
Figure 19B:
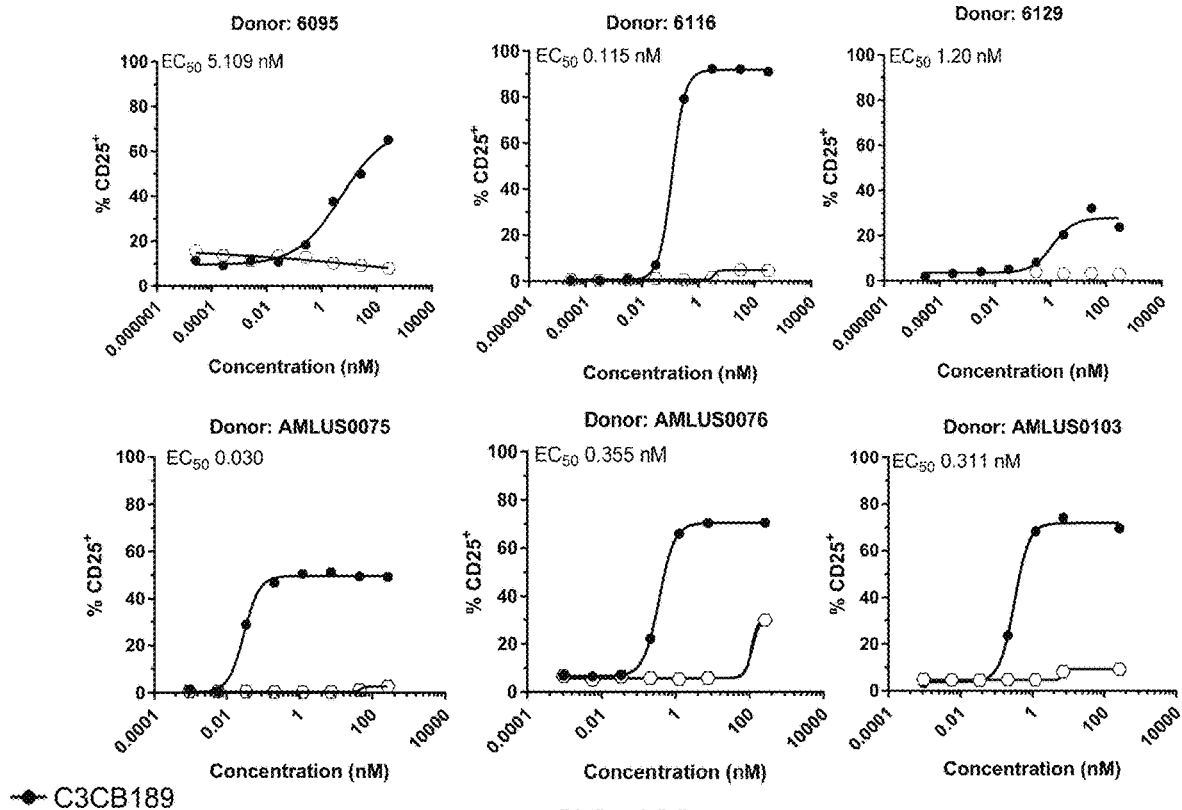

FIGS. 19A and 19B show that C3CB189 mediates cytotoxicity of AML blasts from primary patient samples. FIG. 19A show Ex vivo assessment of C3CB189-mediated cytotoxicity of CD33$^+$ blasts in fresh AML patient whole blood after 48 h. Individual EC$_{50}$ values are shown for each patient sample. FIG. 19B is the same as FIG. 19A but here T cell activation was measured.

Figure 20:
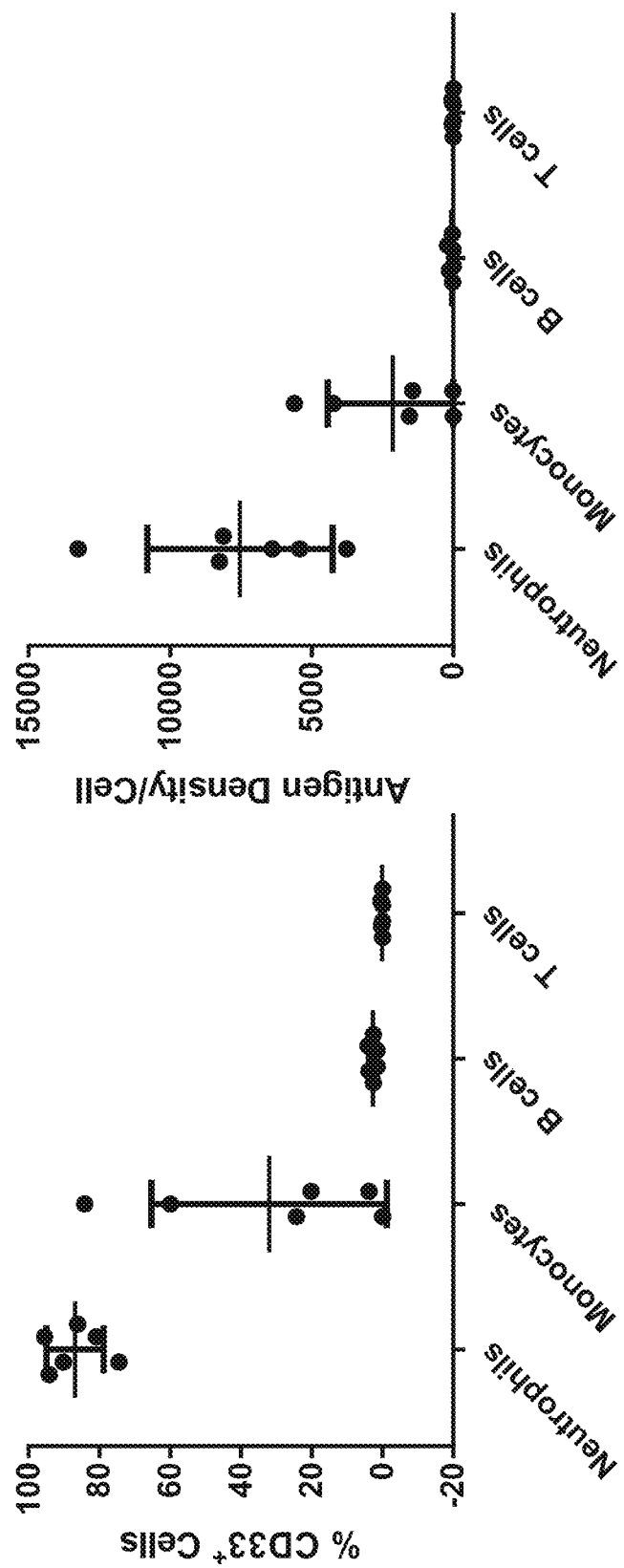

FIG. 20 shows that CD33 is expressed in cynomolgus monkey immune subsets. Whole blood from six normal healthy cynomolgus monkey donors was stained with a monoclonal antibody to CD33 and analyzed by flow cytometry. Mean±SD is graphed.

Figure 21:
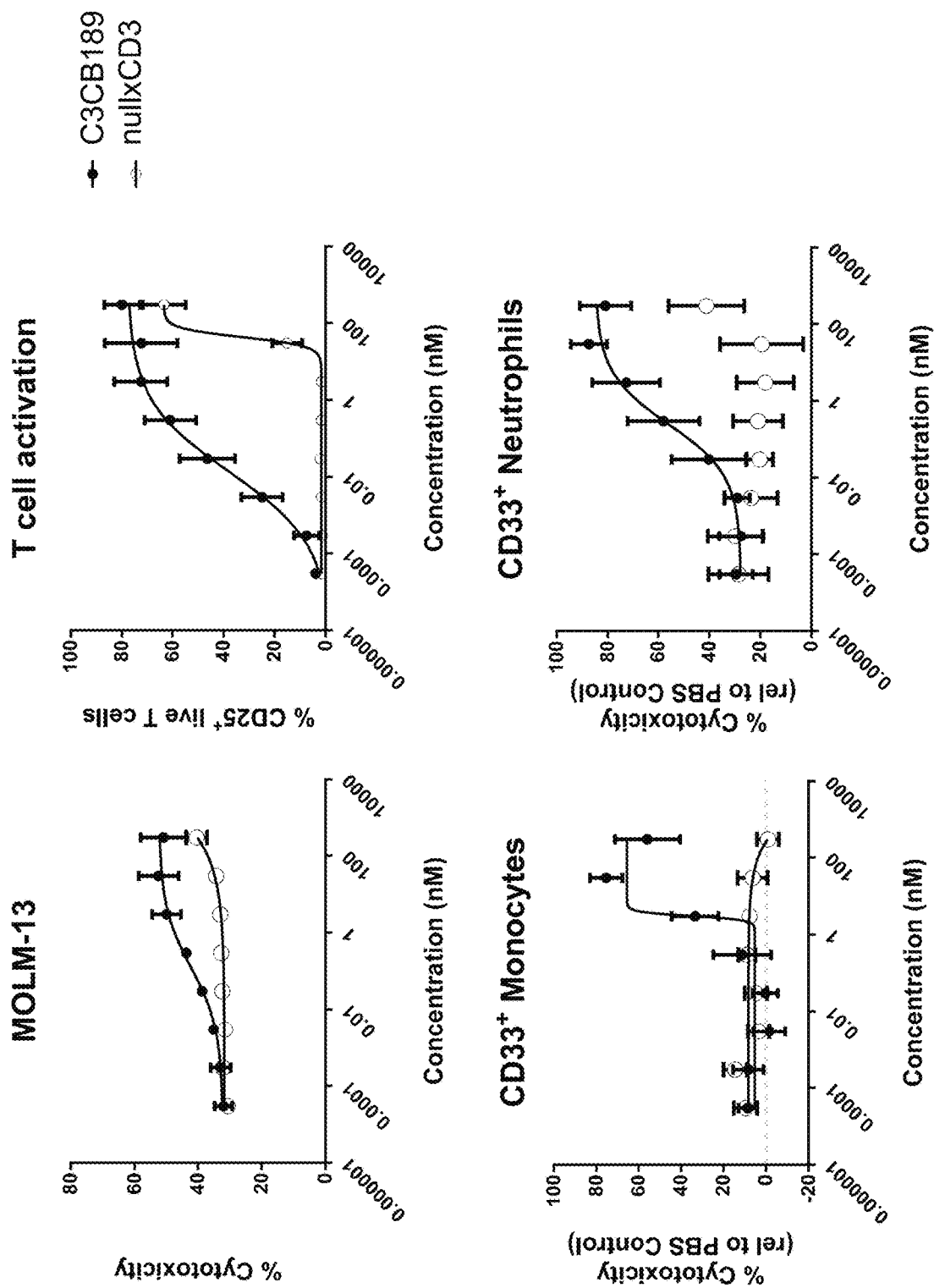

FIG. 21 shows C3CB189 mediates cytotoxicity of MOLM-13 cells, normal CD33$^+$ cyno monocytes and neutrophils along with activating cyno T cells. Ex vivo assessment of C3CB189-mediated cytotoxicity in AML cell line MOLM-13 cells exogenously added to normal healthy cynomolgus monkey whole blood (n=6). Percent of cytotoxicity of MOLM-13 cells, T cell activation, as well cytotoxicity of CD33$^+$ monocytes and neutrophils using C3CB189 and null×CD3 bispecific antibodies are shown. Mean±SEM is graphed.

FIGS. 22A-22D shows C3CB189 mediates reduction of CD33$^+$ leukocytes in cyno monkeys. Cynomolgus monkeys were treated with a single IV dose of control (vehicle), 0.05, 0.2, or 1 mg/kg of C3CB189. FIG. 22A shows C3CB189 concentration over time profiles. FIG. 22B shows T cell activation (% CD25$^+$ in CD8$^+$) in peripheral blood. FIG. 22C shows the effect of C3CB189 on granulocytes (neutrophils). FIG. 22D shows the effect of C3CB189 on monocytes.

Figure 23:
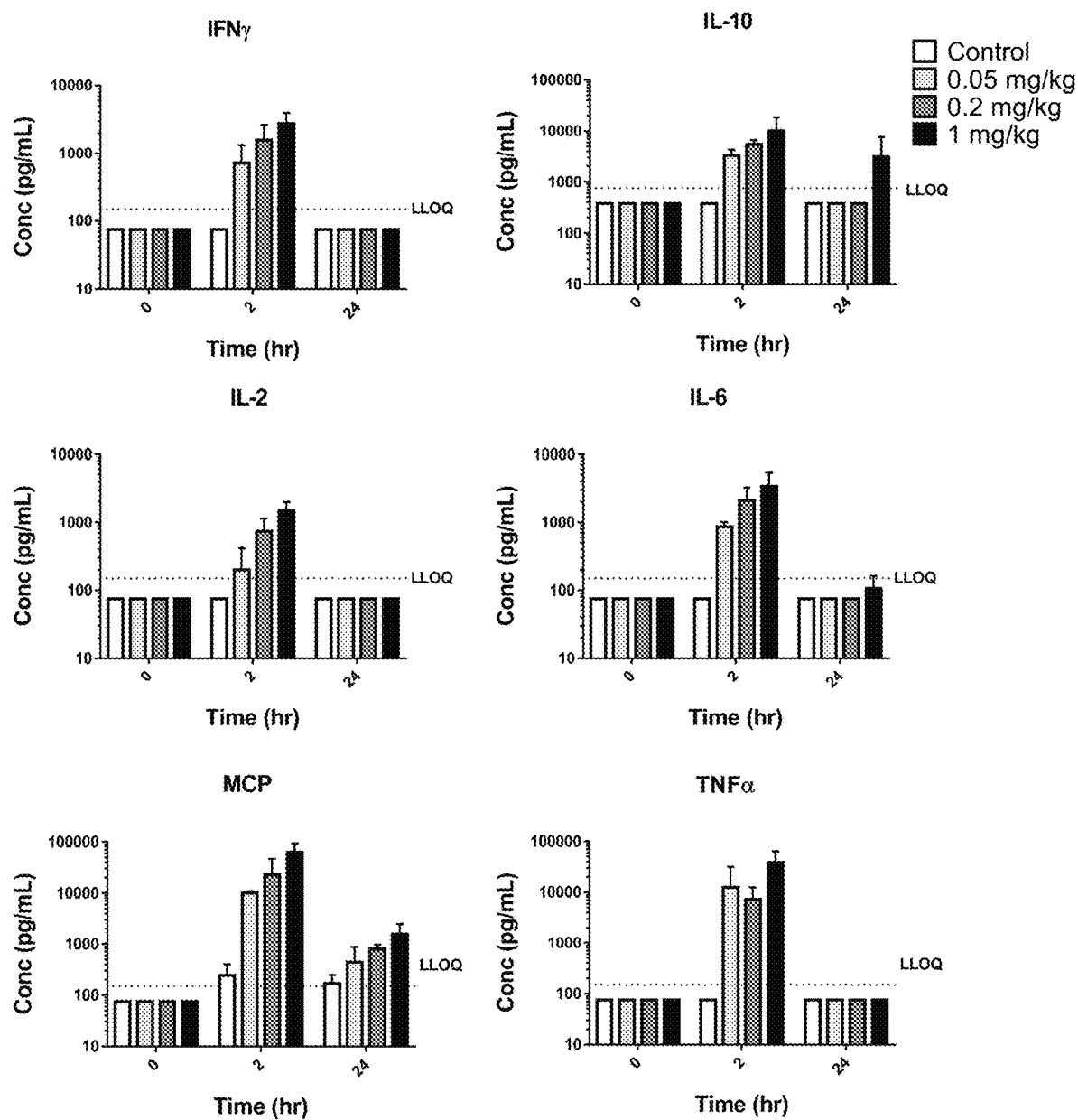

FIG. 23 shows cytokine release following C3CB189 dosing in cyno monkeys. Mean (SD) cytokine levels in cyno monkeys following a single IV dose of C3CB189. (A) IFN☐, (B) IL-10, (C) IL-2, (D) IL-6, (E) MCP, (F) TNF☐.

All below LLOQ values were treated as half of LLOQ for plotting and mean calculation purposes.

Figure 24A:
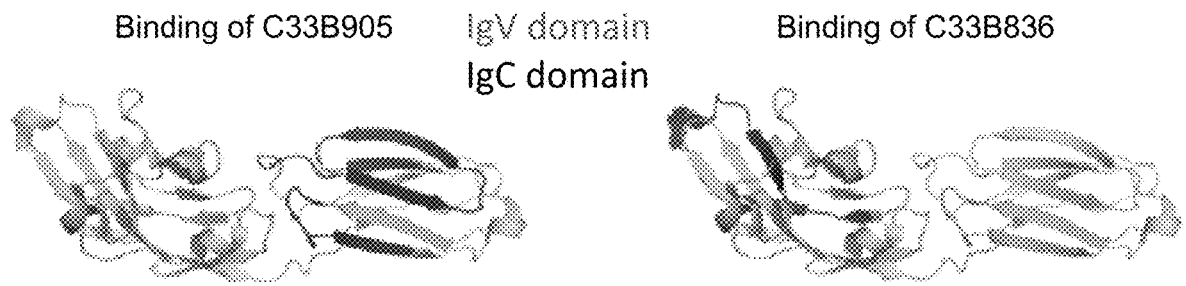
Figure 24B:
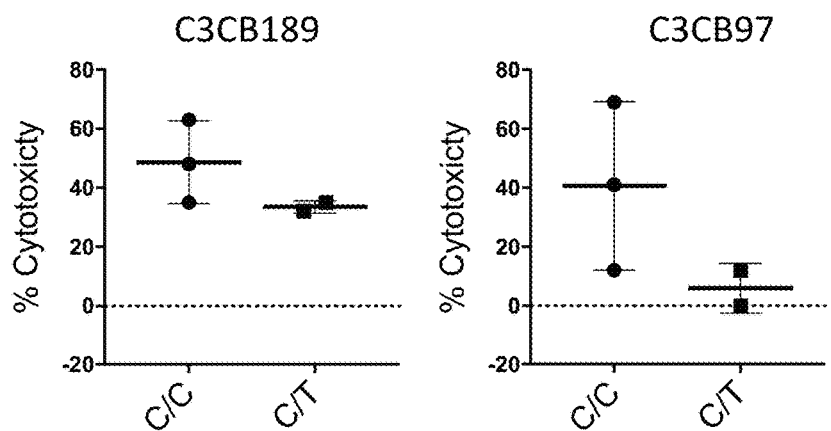
Figure 24C:
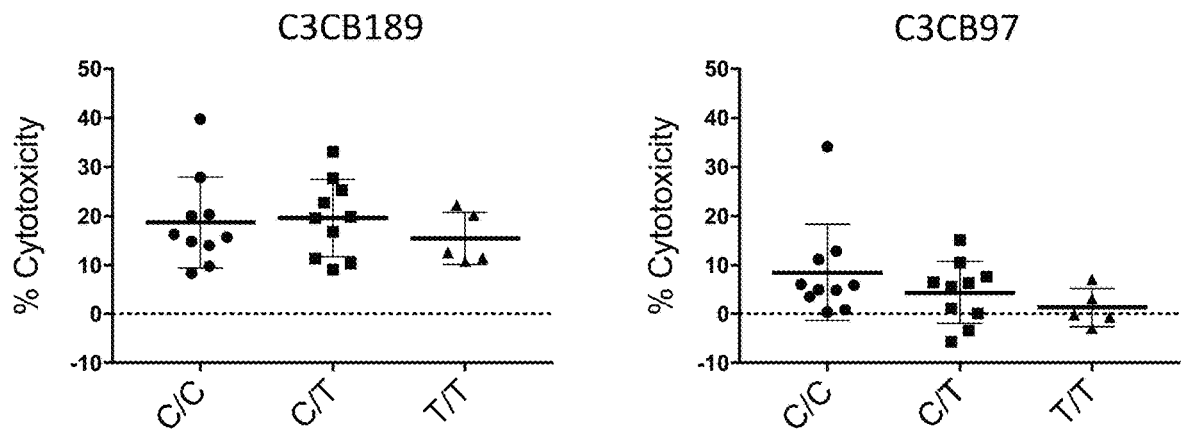

FIGS. 24A-24C show C3CB189 binds to the C2 domain and mediates cytotoxicity of primary samples regardless of their SNP 12459419 genotype status. FIG. 24A shows HDX mapping and subsequent illustration of epitope regions in IgC and IgV domain of CD33 ECD protein for V- and C2-binder mAbs. The V epitope region is colored in blue and the C2 epitope region is colored in red. FIG. 24B shows ex vivo assessment of cytotoxicity of CD33+ blasts in fresh AML patient whole blood was performed at 27 nM of bispecific antibody concentration. Mean±SD is graphed. FIG. 24C shows C3CB189-mediated cytotoxicity of frozen purified monocytes from 25 normal donors was assessed at 0.27 nM of bispecific antibody concentration. Mean±SD is graphed.

FIGS. 25A-25C shows genotyping results for SNP rs12459419. FIG. 25A shows genotyping results from TAQMAN® assays for SNP rs12459419 in cell lines. FIG. 25B is the same as FIG. 25A but here primary patient samples were genotyped. FIG. 25C is the same as FIG. 25A but here frozen monocytes from healthy donors were genotyped using TAQMAN® assays as well as Sanger sequencing.

DETAILED DESCRIPTION OF THE INVENTION

Various publications, articles and patents are cited or described in the background and throughout the specification; each of these references is herein incorporated by reference in its entirety. Discussion of documents, acts, materials, devices, articles or the like which has been included in the present specification is for the purpose of providing context for the invention. Such discussion is not an admission that any or all of these matters form part of the prior art with respect to any inventions disclosed or claimed.

Unless defined otherwise, all technical and scientific terms used herein have the same meaning as commonly understood to one of ordinary skill in the art to which this invention pertains. Otherwise, certain terms used herein have the meanings as set forth in the specification.

It must be noted that as used herein and in the appended claims, the singular forms "a," "an," and "the" include plural reference unless the context clearly dictates otherwise.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the invention.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the conjunctive term "and/or" between multiple recited elements is understood as encompassing both individual and combined options. For instance, where two elements are conjoined by "and/or," a first option refers to the applicability of the first element without the second. A second option refers to the applicability of the second element without the first. A third option refers to the applicability of the first and second elements together. Any one of these options is understood to fall within the meaning, and therefore satisfy the requirement of the term "and/or" as used herein. Concurrent applicability of more than one of the options is also understood to fall within the meaning, and therefore satisfy the requirement of the term "and/or."

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. § 2111.03.

As used herein, "subject" means any animal, preferably a mammal, most preferably a human. The term "mammal" as used herein, encompasses any mammal. Examples of mammals include, but are not limited to, cows, horses, sheep, pigs, cats, dogs, mice, rats, rabbits, guinea pigs, monkeys, humans, etc., more preferably a human.

It should also be understood that the terms "about," "approximately," "generally," "substantially," and like terms, used herein when referring to a dimension or characteristic of a component of the preferred invention, indicate that the described dimension/characteristic is not a strict boundary or parameter and does not exclude minor variations therefrom that are functionally the same or similar, as would be understood by one having ordinary skill in the art. At a minimum, such references that include a numerical parameter would include variations that, using mathematical and industrial principles accepted in the art (e.g., rounding, measurement or other systematic errors, manufacturing tolerances, etc.), would not vary the least significant digit.

The terms "identical" or percent "identity," in the context of two or more nucleic acids or polypeptide sequences (e.g., anti-CD33 antibodies and polynucleotides that encode them, anti-CD33 anti-CD3 bispecific antibodies and polynucleotides that encode them, CD33 polypeptides, and CD33 polynucleotides that encode them), refer to two or more sequences or subsequences that are the same or have a specified percentage of amino acid residues or nucleotides that are the same, when compared and aligned for maximum correspondence, as measured using one of the following sequence comparison algorithms or by visual inspection.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally, *Current Protocols in Molecular Biology*, F. M. Ausubel el al., eds., Current Protocols, a joint venture between Greene Publishing Associates, Inc. and John Wiley & Sons, Inc., (1995 Supplement) (Ausubel)).

Examples of algorithms that are suitable for determining percent sequence identity and sequence similarity are the BLAST and BLAST 2.0 algorithms, which are described in Altschul et al. (1990) *J. Mol. Biol.* 215: 403-410 and Altschul et al. (1997) *Nucleic Acids Res.* 25: 3389-3402, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased.

Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89:10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

A further indication that two nucleic acid sequences or polypeptides are substantially identical is that the polypeptide encoded by the first nucleic acid is immunologically cross reactive with the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules hybridize to each other under stringent conditions, as described below.

Antibodies

The invention generally relates to isolated anti-CD33 antibodies or antigen-binding fragments thereof, nucleic acids and expression vectors encoding the antibodies, recombinant cells containing the vectors, and compositions comprising the antibodies. The invention additionally relates to isolated anti-CD33/anti-CD3 bispecific antibodies or antigen-binding fragments thereof, nucleic acids and expression vectors encoding the antibodies, recombinant cells containing the vectors, and compositions comprising the bispecific antibodies. Methods of making the antibodies, and methods of using the antibodies to treat diseases including cancer are also provided. The antibodies of the invention possess one or more desirable functional properties, including but not limited to high-affinity binding to CD33 and/or CD3, high specificity to CD33 and/or CD3, and the ability to treat or prevent cancer when administered alone or in combination with other anti-cancer therapies.

In a general aspect, the invention relates to isolated monoclonal antibodies or antigen-binding fragments thereof that specifically bind CD33. In certain embodiments, the isolated monoclonal antibodies or antigen-binding fragments thereof bind the C2 domain of CD33. In certain embodiments, the isolated monoclonal antibodies or antigen-binding fragments thereof bind the V domain of CD33.

As used herein, the term "antibody" is used in a broad sense and includes immunoglobulin or antibody molecules including human, humanized, composite and chimeric antibodies and antibody fragments that are monoclonal or polyclonal. In general, antibodies are proteins or peptide chains that exhibit binding specificity to a specific antigen. Antibody structures are well known. Immunoglobulins can be assigned to five major classes (i.e., IgA, IgD, IgE, IgG and IgM), depending on the heavy chain constant domain amino acid sequence. IgA and IgG are further sub-classified as the isotypes IgA1, IgA2, IgG1, IgG2, IgG3 and IgG4. Accordingly, the antibodies of the invention can be of any of the five major classes or corresponding sub-classes. Preferably, the antibodies of the invention are IgG1, IgG2, IgG3 or IgG4. Antibody light chains of vertebrate species can be assigned to one of two clearly distinct types, namely kappa and lambda, based on the amino acid sequences of their constant domains. Accordingly, the antibodies of the invention can contain a kappa or lambda light chain constant domain. According to particular embodiments, the antibodies of the invention include heavy and/or light chain constant regions from rat or human antibodies. In addition to the heavy and light constant domains, antibodies contain an antigen-binding region that is made up of a light chain variable region and a heavy chain variable region, each of which contains three domains (i.e., complementarity determining regions 1-3; CDR1, CDR2, and CDR3). The light chain variable region domains are alternatively referred to as LCDR1, LCDR2, and LCRD3, and the heavy chain variable region domains are alternatively referred to as HCDR1, HCRD2, and HCDR3.

As used herein, the term an "isolated antibody" refers to an antibody which is substantially free of other antibodies having different antigenic specificities (e.g., an isolated antibody that specifically binds to CD33 is substantially free of antibodies that do not bind to CD33). In addition, an isolated antibody is substantially free of other cellular material and/or chemicals.

As used herein, the term "monoclonal antibody" refers to an antibody obtained from a population of substantially homogeneous antibodies, i.e., the individual antibodies comprising the population are identical except for possible naturally occurring mutations that may be present in minor amounts. The monoclonal antibodies of the invention can be made by the hybridoma method, phage display technology, single lymphocyte gene cloning technology, or by recombinant DNA methods. For example, the monoclonal antibodies can be produced by a hybridoma which includes a B cell obtained from a transgenic nonhuman animal, such as a transgenic mouse or rat, having a genome comprising a human heavy chain transgene and a light chain transgene.

As used herein, the term "antigen-binding fragment" refers to an antibody fragment such as, for example, a diabody, a Fab, a Fab', a F(ab')2, an Fv fragment, a disulfide stabilized Fv fragment (dsFv), a $(dsFv)_2$, a bispecific dsFv (dsFv-dsFv'), a disulfide stabilized diabody (ds diabody), a single-chain antibody molecule (scFv), a single domain antibody (sdab) an scFv dimer (bivalent diabody), a multispecific antibody formed from a portion of an antibody comprising one or more CDRs, a camelized single domain antibody, a nanobody, a domain antibody, a bivalent domain antibody, or any other antibody fragment that binds to an antigen but does not comprise a complete antibody structure. An antigen-binding fragment is capable of binding to the same antigen to which the parent antibody or a parent antibody fragment binds. According to particular embodiments, the antigen-binding fragment comprises a light chain variable region, a light chain constant region, and an Fd segment of the heavy chain. According to other particular embodiments, the antigen-binding fragment comprises Fab and F(ab').

As used herein, the term "single-chain antibody" refers to a conventional single-chain antibody in the field, which comprises a heavy chain variable region and a light chain variable region connected by a short peptide of about 15 to about 20 amino acids. As used herein, the term "single domain antibody" refers to a conventional single domain antibody in the field, which comprises a heavy chain variable region and a heavy chain constant region or which comprises only a heavy chain variable region.

As used herein, the term "human antibody" refers to an antibody produced by a human or an antibody having an amino acid sequence corresponding to an antibody produced by a human made using any technique known in the art. This definition of a human antibody includes intact or full-length antibodies, fragments thereof, and/or antibodies comprising at least one human heavy and/or light chain polypeptide.

As used herein, the term "humanized antibody" refers to a non-human antibody that is modified to increase the sequence homology to that of a human antibody, such that the antigen-binding properties of the antibody are retained, but its antigenicity in the human body is reduced.

As used herein, the term "chimeric antibody" refers to an antibody wherein the amino acid sequence of the immunoglobulin molecule is derived from two or more species. The variable region of both the light and heavy chains often corresponds to the variable region of an antibody derived from one species of mammal (e.g., mouse, rat, rabbit, etc.) having the desired specificity, affinity, and capability, while the constant regions correspond to the sequences of an antibody derived from another species of mammal (e.g., human) to avoid eliciting an immune response in that species.

As used herein, the term "multispecific antibody" refers to an antibody that comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, the first and second epitopes are on the same antigen, e.g., the same protein (or subunit of a multimeric protein). In an embodiment, the first and second epitopes overlap or substantially overlap. In an embodiment, the first and second epitopes do not overlap or do not substantially overlap. In an embodiment, the first and second epitopes are on different antigens, e.g., the different proteins (or different subunits of a multimeric protein). In an embodiment, a multispecific antibody comprises a third, fourth, or fifth immunoglobulin variable domain. In an embodiment, a multispecific antibody is a bispecific antibody molecule, a trispecific antibody molecule, or a tetraspecific antibody molecule.

As used herein, the term "bispecific antibody" refers to a multispecific antibody that binds no more than two epitopes or two antigens. A bispecific antibody is characterized by a first immunoglobulin variable domain sequence which has binding specificity for a first epitope and a second immunoglobulin variable domain sequence that has binding specificity for a second epitope. In an embodiment, the first and second epitopes are on the same antigen, e.g., the same protein (or subunit of a multimeric protein). In an embodiment, the first and second epitopes overlap or substantially overlap. In an embodiment, the first and second epitopes are on different antigens, e.g., the different proteins (or different subunits of a multimeric protein). In an embodiment, a bispecific antibody comprises a heavy chain variable domain sequence and a light chain variable domain sequence which have binding specificity for a first epitope and a heavy chain variable domain sequence and a light chain variable domain sequence which have binding specificity for a second epitope. In an embodiment, a bispecific antibody comprises a half antibody, or fragment thereof, having binding specificity for a first epitope and a half antibody, or fragment thereof, having binding specificity for a second epitope. In an embodiment, a bispecific antibody comprises a scFv, or fragment thereof, having binding specificity for a first epitope, and a scFv, or fragment thereof, having binding specificity for a second epitope. In an embodiment, the first epitope is located on CD33 and the second epitope is located on CD3. In an embodiment, the first epitope is located on CD33 and the second epitope is located on PD-1, PD-L1, LAG-3, TIM-3, CTLA-4, EGFR, HER-2, CD19, CD20, CD3 and/or other tumor associated immune suppressors or surface antigens.

As used herein, the term "CD33" refers to a 67 kD single pass transmembrane glycoprotein, which is a member of the sialic acid-binding immunoglobulin-like lectins (Siglecs) family. CD33 is also known as Siglec-3, gp67, or p67. The structure of CD33 consists of an amino-terminal V-set Ig-like domain (coded by exon 2 of CD33) that mediates sialic acid binding and a C2-set IG-like domain (coded by exon 4) in its extracellular portion (Laszlo et al., 2016). Alternative splicing of CD33 RNA can lead to a shorter isoform that is expressed on the cell surface, which lacks the V- but retains the C2-set Ig-like domain (Laszlo, Estey, & Walter, 2014; Laszlo et al., 2016). The biological relevance of this splicing process was largely unknown until recent studies showed that a single nucleotide polymorphism (SNP) rs12459419 was present in ~50% of the AML population and leads to skipping of exon 2 of CD33 which results in the deletion of the V domain of CD33 (Lamba et al., 2017). The full length human CD33 is provided by Uniprot P20138 (SEQ ID NO:1).

As used herein, an antibody that "specifically binds to CD33" refers to an antibody that binds to a CD33, preferably a human CD33, preferably the C2 domain of CD33, with a KD of $1\times10^{-7}$ M or less, preferably $1\times10^{-8}$ M or less, more preferably $5\times10^{-9}$ M or less, $1\times10^{-9}$ M or less, $5\times10^{-10}$ M or less, or $1\times10^{-10}$ M or less. The term "KD" refers to the dissociation constant, which is obtained from the ratio of Kd to Ka (i.e., Kd/Ka) and is expressed as a molar concentration (M). KD values for antibodies can be determined using methods in the art in view of the present disclosure. For example, the KD of an antibody can be determined by using surface plasmon resonance, such as by using a biosensor system, e.g., a BIACORE® system, or by using bio-layer interferometry technology, such as an OCTET® RED96 system.

The smaller the value of the KD of an antibody, the higher affinity that the antibody binds to a target antigen.

According to a particular aspect, the invention relates to an isolated monoclonal antibody or antigen-binding fragment thereof comprising a heavy chain complementarity determining region 1 (HCDR1), a HCDR2, a HCDR3, a light chain complementarity determining region 1 (LCDR1), a LCDR2, and a LCDR3, having the polypeptide sequences of:

a. SEQ ID NOs:447, 448, 449, 567, 568, and 569, respectively;
b. SEQ ID NOs:444, 445, 446, 564, 565, and 566, respectively;
c. SEQ ID NOs:354, 355, 356, 477, 478, and 479, respectively;
d. SEQ ID NOs:378, 379, 380, 501, 502, and 503, respectively;
e. SEQ ID NOs:411, 412, 413, 531, 532, and 533, respectively;
f. SEQ ID NOs:348, 349, 350, 471, 472, and 473, respectively;
g. SEQ ID NOs:360, 361, 362, 483, 484, and 485, respectively;
h. SEQ ID NOs:363, 364, 365, 486, 487, and 488, respectively;
i. SEQ ID NOs:366, 367, 368, 489, 490, and 491, respectively;
j. SEQ ID NOs:369, 370, 371, 492, 493, and 494, respectively;
k. SEQ ID NOs:387, 388, 389, 492, 493, and 494, respectively;
l. SEQ ID NOs:402, 403, 404, 522, 523, and 524, respectively;
m. SEQ ID NOs:408, 409, 410, 528, 529, and 530, respectively;
n. SEQ ID NOs:423, 424, 425, 543, 544, and 545, respectively;
o. SEQ ID NOs:426, 427, 428, 546, 547, and 548, respectively;
p. SEQ ID NOs:351, 352, 353, 474, 475, and 476, respectively;
q. SEQ ID NOs:357, 358, 359, 480, 481, and 482, respectively;
r. SEQ ID NOs:372, 373, 374, 495, 496, and 497, respectively;
s. SEQ ID NOs:375, 376, 377, 498, 499, and 500, respectively;
t. SEQ ID NOs:381, 382, 383, 504, 505, and 506, respectively;
u. SEQ ID NOs:384, 385, 386, 507, 508, and 509, respectively;
v. SEQ ID NOs:390, 391, 392, 510, 511, and 512, respectively;
w. SEQ ID NOs:393, 394, 395, 513, 514, and 515, respectively;
x. SEQ ID NOs:396, 397, 398, 516, 517, and 518, respectively;
y. SEQ ID NOs:399, 400, 401, 519, 520, and 521, respectively;
z. SEQ ID NOs:405, 406, 407, 525, 526, and 527, respectively;
aa. SEQ ID NOs:414, 415, 416, 534, 535, and 536, respectively;
bb. SEQ ID NOs:417, 418, 419, 537, 538, and 539, respectively;
cc. SEQ ID NOs:420, 421, 422, 540, 541, and 542, respectively;
dd. SEQ ID NOs:429, 430, 431, 549, 550, and 551, respectively;
ee. SEQ ID NOs:432, 433, 434, 552, 553, and 554, respectively;
ff. SEQ ID NOs:435, 436, 437, 555, 556, and 557, respectively;
gg. SEQ ID NOs:438, 439, 440, 558, 559, and 560, respectively;
hh. SEQ ID NOs:441, 442, 443, 561, 562, and 563, respectively;
ii. SEQ ID NOs:450, 451, 452, 570, 571, and 572, respectively;
jj SEQ ID NOs:453, 454, 455, 573, 574, and 575, respectively;
kk. SEQ ID NOs:456, 457, 458, 576, 577, and 578, respectively;
ll. SEQ ID NOs:459, 460, 461, 579, 580, and 581, respectively;
mm. SEQ ID NOs:378, 379, 380, 582, 583, and 584, respectively;
nn. SEQ ID NOs:414, 415, 416, 585, 586, and 587, respectively; or
oo. SEQ ID NOs:429, 430, 431, 480, 481, and 482, respectively;

wherein the antibody or antigen-binding fragment thereof specifically binds CD33, preferably human CD33.

According to another particular aspect, the invention relates to an isolated monoclonal antibody or antigen-binding fragment thereof comprising a heavy chain variable region having a polypeptide sequence at least 85%, preferably 90%, more preferably 95% or more, such as 95%, 96%, 97%, 98%, or 99% identical to one of SEQ ID NOs:259-296, or a light chain variable region having a polypeptide sequence at least 85%, preferably 90%, more preferably 95% or more, such as 95%, 96%, 97%, 98%, or 99% identical to one of SEQ ID NOs:300-338. According to one preferred embodiment, the isolated monoclonal antibody or antigen-binding fragment thereof of the invention comprises a heavy chain variable region having the polypeptide sequence at least 85%, preferably 90%, more preferably 95% or more, such as 95%, 96%, 97%, 98%, or 99% identical to one of SEQ ID NOs:259-296, and a light chain variable region having a polypeptide sequence at least 85%, preferably 90%, more preferably 95% or more, such as 95%, 96%, 97%, 98%, or 99% identical to one of SEQ ID NOs:300-338, respectively.

According to another particular aspect, the invention relates to an isolated monoclonal antibody or antigen-binding fragment thereof of the invention, comprising:

a. a heavy chain variable region having the polypeptide sequence of SEQ ID NO:292, and a light chain variable region having the polypeptide sequence of SEQ ID NO:332;
b. a heavy chain variable region having the polypeptide sequence of SEQ ID NO:291, and a light chain variable region having the polypeptide sequence of SEQ ID NO:331;
c. a heavy chain variable region having the polypeptide sequence of SEQ ID NO:261, and a light chain variable region having the polypeptide sequence of SEQ ID NO:302;
d. a heavy chain variable region having the polypeptide sequence of SEQ ID NO:269, and a light chain variable region having the polypeptide sequence of SEQ ID NO:310;
e. a heavy chain variable region having the polypeptide sequence of SEQ ID NO:280, and a light chain variable region having the polypeptide sequence of SEQ ID NO:322;
f. a heavy chain variable region having the polypeptide sequence of SEQ ID NO:259, and a light chain variable region having the polypeptide sequence of SEQ ID NO:300;
g. a heavy chain variable region having the polypeptide sequence of SEQ ID NO:263, and a light chain variable region having the polypeptide sequence of SEQ ID NO:304;
h. a heavy chain variable region having the polypeptide sequence of SEQ ID NO:264, and a light chain variable region having the polypeptide sequence of SEQ ID NO:305;
i. a heavy chain variable region having the polypeptide sequence of SEQ ID NO:265, and a light chain variable region having the polypeptide sequence of SEQ ID NO:306;
j. a heavy chain variable region having the polypeptide sequence of SEQ ID NO:266, and a light chain variable region having the polypeptide sequence of SEQ ID NO:307;
k. a heavy chain variable region having the polypeptide sequence of SEQ ID NO:272, and a light chain variable region having the polypeptide sequence of SEQ ID NO:307;
l. a heavy chain variable region having the polypeptide sequence of SEQ ID NO:277, and a light chain variable region having the polypeptide sequence of SEQ ID NO:317;
m. a heavy chain variable region having the polypeptide sequence of SEQ ID NO:279, and a light chain variable region having the polypeptide sequence of SEQ ID NO:319;
n. a heavy chain variable region having the polypeptide sequence of SEQ ID NO:284, and a light chain variable region having the polypeptide sequence of SEQ ID NO:324;
o. a heavy chain variable region having the polypeptide sequence of SEQ ID NO:285, and a light chain variable region having the polypeptide sequence of SEQ ID NO:325;
p. a heavy chain variable region having the polypeptide sequence of SEQ ID NO:260, and a light chain variable region having the polypeptide sequence of SEQ ID NO:301;
q. a heavy chain variable region having the polypeptide sequence of SEQ ID NO:262, and a light chain variable region having the polypeptide sequence of SEQ ID NO:303;
r. a heavy chain variable region having the polypeptide sequence of SEQ ID NO:267, and a light chain variable region having the polypeptide sequence of SEQ ID NO:308;
s. a heavy chain variable region having the polypeptide sequence of SEQ ID NO:268, and a light chain variable region having the polypeptide sequence of SEQ ID NO:309;
t. a heavy chain variable region having the polypeptide sequence of SEQ ID NO:270, and a light chain variable region having the polypeptide sequence of SEQ ID NO:311;
u. a heavy chain variable region having the polypeptide sequence of SEQ ID NO:271, and a light chain variable region having the polypeptide sequence of SEQ ID NO:312;
v. a heavy chain variable region having the polypeptide sequence of SEQ ID NO:273, and a light chain variable region having the polypeptide sequence of SEQ ID NO:313;
w. a heavy chain variable region having the polypeptide sequence of SEQ ID NO:274, and a light chain variable region having the polypeptide sequence of SEQ ID NO:314;
x. a heavy chain variable region having the polypeptide sequence of SEQ ID NO:275, and a light chain variable region having the polypeptide sequence of SEQ ID NO:315;
y. a heavy chain variable region having the polypeptide sequence of SEQ ID NO:276, and a light chain variable region having the polypeptide sequence of SEQ ID NO:316;
z. a heavy chain variable region having the polypeptide sequence of SEQ ID NO:278, and a light chain variable region having the polypeptide sequence of SEQ ID NO:318;
aa. a heavy chain variable region having the polypeptide sequence of SEQ ID NO:281, and a light chain variable region having the polypeptide sequence of SEQ ID NO:321;
bb. a heavy chain variable region having the polypeptide sequence of SEQ ID NO:282, and a light chain variable region having the polypeptide sequence of SEQ ID NO:322;

cc. a heavy chain variable region having the polypeptide sequence of SEQ ID NO:283, and a light chain variable region having the polypeptide sequence of SEQ ID NO:323;
dd. a heavy chain variable region having the polypeptide sequence of SEQ ID NO:286, and a light chain variable region having the polypeptide sequence of SEQ ID NO:326;
ee. a heavy chain variable region having the polypeptide sequence of SEQ ID NO:287, and a light chain variable region having the polypeptide sequence of SEQ ID NO:327;
ff. a heavy chain variable region having the polypeptide sequence of SEQ ID NO:288, and a light chain variable region having the polypeptide sequence of SEQ ID NO:328;
gg. a heavy chain variable region having the polypeptide sequence of SEQ ID NO:289, and a light chain variable region having the polypeptide sequence of SEQ ID NO:329;
hh. a heavy chain variable region having the polypeptide sequence of SEQ ID NO:290, and a light chain variable region having the polypeptide sequence of SEQ ID NO:330;
ii. a heavy chain variable region having the polypeptide sequence of SEQ ID NO:293, and a light chain variable region having the polypeptide sequence of SEQ ID NO:333;
jj. a heavy chain variable region having the polypeptide sequence of SEQ ID NO:294, and a light chain variable region having the polypeptide sequence of SEQ ID NO:334;
kk. a heavy chain variable region having the polypeptide sequence of SEQ ID NO:295, and a light chain variable region having the polypeptide sequence of SEQ ID NO:335;
ll. a heavy chain variable region having the polypeptide sequence of SEQ ID NO:296, and a light chain variable region having the polypeptide sequence of SEQ ID NO:336;
mm. a heavy chain variable region having the polypeptide sequence of SEQ ID NO:269, and a light chain variable region having the polypeptide sequence of SEQ ID NO:337;
nn. a heavy chain variable region having the polypeptide sequence of SEQ ID NO:281, and a light chain variable region having the polypeptide sequence of SEQ ID NO:338; or
oo. a heavy chain variable region having the polypeptide sequence of SEQ ID NO:286, and a light chain variable region having the polypeptide sequence of SEQ ID NO:303.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:348, 349, 350, 471, 472, and 473, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:259, and a light chain variable region having a polypeptide sequence at least 85%, preferably 90%, more preferably 95% or more, such as 95%, 96%, 97%, 98%, or 99% identical to SEQ ID NO:300. Preferably, the isolated monoclonal antibody or antigen-binding fragment thereof comprises a heavy chain variable region having the polypeptide sequence of SEQ ID NO:259; and a light chain variable region having the polypeptide sequence of SEQ ID NO:300.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:351, 352, 353, 474, 475, and 476, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:260, and a light chain variable region having a polypeptide sequence at least 85%, preferably 90%, more preferably 95% or more, such as 95%, 96%, 97%, 98%, or 99% identical to SEQ ID NO:301. Preferably, the isolated monoclonal antibody or antigen-binding fragment thereof comprises a heavy chain variable region having the polypeptide sequence of SEQ ID NO:260; and a light chain variable region having the polypeptide sequence of SEQ ID NO:301.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:354, 355, 356, 477, 478, and 479, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:261, and a light chain variable region having a polypeptide sequence at least 85%, preferably 90%, more preferably 95% or more, such as 95%, 96%, 97%, 98%, or 99% identical to SEQ ID NO:302. Preferably, the isolated monoclonal antibody or antigen-binding fragment thereof comprises a heavy chain variable region having the polypeptide sequence of SEQ ID NO:261; and a light chain variable region having the polypeptide sequence of SEQ ID NO:301.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:357, 358, 359, 480, 481, and 482, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:262, and a light chain variable region having a polypeptide sequence at least 85%, preferably 90%, more preferably 95% or more, such as 95%, 96%, 97%, 98%, or 99% identical to SEQ ID NO:303. Preferably, the isolated monoclonal antibody or antigen-binding fragment thereof comprises a heavy chain variable region having the polypeptide sequence of SEQ ID NO:262; and a light chain variable region having the polypeptide sequence of SEQ ID NO:303.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:360, 361, 362, 483, 484, and 485, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:263, and a light chain variable region having a polypeptide sequence at least 85%, preferably 90%, more preferably 95% or more, such as 95%, 96%, 97%, 98%, or 99% identical to SEQ ID NO:304. Preferably, the isolated monoclonal antibody or antigen-binding fragment thereof comprises a heavy chain variable region having the polypeptide sequence of SEQ ID NO:263; and a light chain variable region having the polypeptide sequence of SEQ ID NO:304.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:363, 364, 365, 486, 487, and 488, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:264, and a light chain variable region having a polypeptide sequence at least 85%, preferably 90%, more preferably 95% or more, such as 95%, 96%, 97%, 98%, or 99% identical to SEQ ID NO:305. Preferably, the isolated monoclonal antibody or antigen-binding fragment thereof comprises a heavy chain variable region having the polypeptide sequence of SEQ ID NO:264; and a light chain variable region having the polypeptide sequence of SEQ ID NO:305.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:366, 367, 368, 489, 490, and 491, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:265, and a light chain variable region having a polypeptide sequence at least 85%, preferably 90%, more preferably 95% or more, such as 95%, 96%, 97%, 98%, or 99% identical to SEQ ID NO:306. Preferably, the isolated monoclonal antibody or antigen-binding fragment thereof comprises a heavy chain variable region having the polypeptide sequence of SEQ ID NO:265; and a light chain variable region having the polypeptide sequence of SEQ ID NO:306.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:369, 370, 371, 492, 493, and 494, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99/o identical to SEQ ID NO:266, and a light chain variable region having a polypeptide sequence at least 85%, preferably 90%, more preferably 95% or more, such as 95%, 96%, 97%, 98%, or 99% identical to SEQ ID NO:307. Preferably, the isolated monoclonal antibody or antigen-binding fragment thereof comprises a heavy chain variable region having the polypeptide sequence of SEQ ID NO:266; and a light chain variable region having the polypeptide sequence of SEQ ID NO:307.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:372, 373, 374, 495, 496, and 497, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:267, and a light chain variable region having a polypeptide sequence at least 85%, preferably 90%, more preferably 95% or more, such as 95%, 96%, 97%, 98%, or 99% identical to SEQ ID NO:308. Preferably, the isolated monoclonal antibody or antigen-binding fragment thereof comprises a heavy chain variable region having the polypeptide sequence of SEQ ID NO:267; and a light chain variable region having the polypeptide sequence of SEQ ID NO:308.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:375, 376, 377, 498, 499, and 500, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:268, and a light chain variable region having a polypeptide sequence at least 85%, preferably 90%, more preferably 95% or more, such as 95%, 96%, 97%, 98%, or 99% identical to SEQ ID NO:309. Preferably, the isolated monoclonal antibody or antigen-binding fragment thereof comprises a heavy chain variable region having the polypeptide sequence of SEQ ID N0:268; and a light chain variable region having the polypeptide sequence of SEQ ID NO:309.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:378, 379, 380, 501, 502, and 503, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:269, and a light chain variable region having a polypeptide sequence at least 85%, preferably 90%, more preferably 95% or more, such as 95%, 96%, 97%, 98%, or 99% identical to SEQ ID NO:310. Preferably, the isolated monoclonal antibody or antigen-binding fragment thereof comprises a heavy chain variable region having the polypeptide sequence of SEQ ID NO:269; and a light chain variable region having the polypeptide sequence of SEQ ID NO:310.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:381, 382, 383, 504, 505, and 506, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:270, and a light chain variable region having a polypeptide sequence at least 85%, preferably 90%, more preferably 95% or more, such as 95%, 96%, 97%, 98%, or 99% identical to SEQ ID NO:311. Preferably, the isolated monoclonal antibody or antigen-binding fragment thereof comprises a heavy chain variable region having the polypeptide sequence of SEQ ID NO:270; and a light chain variable region having the polypeptide sequence of SEQ ID NO:311.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:384, 385, 386, 507, 508, and 509, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:271, and a light chain variable region having a polypeptide sequence at least 85%, preferably 90%, more preferably 95% or more, such as 95%, 96%, 97%, 98%, or 99% identical to SEQ ID NO:312. Preferably, the isolated monoclonal antibody or antigen-binding fragment thereof comprises a heavy chain variable region having the polypeptide sequence of SEQ ID NO:271; and a light chain variable region having the polypeptide sequence of SEQ ID NO:312.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:387, 388, 389, 492, 493, and 494, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:272, and a light chain variable region having a polypeptide sequence at least 85%, preferably 90%, more preferably 95% or more, such as 95%, 96%, 97%, 98%, or 99% identical to SEQ ID NO:307. Preferably, the isolated monoclonal antibody or antigen-binding fragment thereof comprises a heavy chain variable region having the polypeptide sequence of SEQ ID NO:272; and a light chain variable region having the polypeptide sequence of SEQ ID NO:307.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:390, 391, 392, 510, 511, and 512, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:273, and a light chain variable region having a polypeptide sequence at least 85%, preferably 90%, more preferably 95% or more, such as 95%, 96%, 97%, 98%, or 99/a identical to SEQ ID NO:313. Preferably, the isolated monoclonal antibody or antigen-binding fragment thereof comprises a heavy chain variable region having the polypeptide sequence of SEQ ID NO:273; and a light chain variable region having the polypeptide sequence of SEQ ID NO:313.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:393, 394, 395, 513, 54, and 515, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:274, and a light chain variable region having a polypeptide sequence at least 85%, preferably 90%, more preferably 95% or more, such as 95%, 96%, 97%, 98%, or 99% identical to SEQ ID NO:314. Preferably, the isolated monoclonal antibody or antigen-binding fragment thereof comprises a heavy chain variable region having the polypeptide sequence of SEQ ID NO:274; and a light chain variable region having the polypeptide sequence of SEQ ID NO:314.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:396, 397, 398, 516, 517, and 518, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:275, and a light chain variable region having a polypeptide sequence at least 85%, preferably 90%, more preferably 95% or more, such as 95%, 96%, 97%, 98%, or 99% identical to SEQ ID NO:315. Preferably, the isolated monoclonal antibody or antigen-binding fragment thereof comprises a heavy chain variable region having the polypeptide sequence of SEQ ID NO:275; and a light chain variable region having the polypeptide sequence of SEQ ID NO:315.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:399, 400, 401, 519, 520, and 521, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:276, and a light chain variable region having a polypeptide sequence at least 85%, preferably 90%, more preferably 95% or more, such as 95%, 96%, 97%, 98%, or 99% identical to SEQ ID NO:316. Preferably, the isolated monoclonal antibody or antigen-binding fragment thereof comprises a heavy chain variable region having the polypeptide sequence of SEQ ID NO:276; and a light chain variable region having the polypeptide sequence of SEQ ID NO:316.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:402, 403, 404, 522, 523, and 524, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:277, and a light chain variable region having a polypeptide sequence at least 85%, preferably 90%, more preferably 95% or more, such as 95%, 96%, 97%, 98%, or 99% identical to SEQ ID NO:317. Preferably, the isolated monoclonal antibody or antigen-binding fragment thereof comprises a heavy chain variable region having the polypeptide sequence of SEQ ID NO:277; and a light chain variable region having the polypeptide sequence of SEQ ID NO:317.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:405, 406, 407, 525, 526, and 527, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:278, and a light chain variable region having a polypeptide sequence at least 85%, preferably 90%, more preferably 95% or more, such as 95%, 96%, 97%, 98%, or 99% identical to SEQ ID NO:318. Preferably, the isolated monoclonal antibody or antigen-binding fragment thereof comprises a heavy chain variable region having the polypeptide sequence of SEQ ID NO:278; and a light chain variable region having the polypeptide sequence of SEQ ID NO:318.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:408, 409, 410, 528, 529, and 530, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:279, and a light chain variable region having a polypeptide sequence at least 85%, preferably 90%, more preferably 95% or more, such as 95%, 96%, 97%, 98%, or 99% identical to SEQ ID NO:319. Preferably, the isolated monoclonal antibody or antigen-binding fragment thereof comprises a heavy chain variable region having the polypeptide sequence of SEQ ID NO:279; and a light chain variable region having the polypeptide sequence of SEQ ID NO:319.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:411, 412, 413, 531, 532, and 533, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:280, and a light chain variable region having a polypeptide sequence at least 85%, preferably 90%, more preferably 95% or more, such as 95%, 96%, 97%, 98%, or 99/o identical to SEQ ID NO:320. Preferably, the isolated monoclonal antibody or antigen-binding fragment thereof comprises a heavy chain variable region having the polypeptide sequence of SEQ ID NO:280; and a light chain variable region having the polypeptide sequence of SEQ ID NO:320.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:414, 415, 416, 534, 535, and 536, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:281, and a light chain variable region having a polypeptide sequence at least 85%, preferably 90%, more preferably 95% or more, such as 95%, 96%, 97%, 98%, or 99% identical to SEQ ID NO:321. Preferably, the isolated monoclonal antibody or antigen-binding fragment thereof comprises a heavy chain variable region having the polypeptide sequence of SEQ ID NO:281; and a light chain variable region having the polypeptide sequence of SEQ ID NO:321.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:417, 418, 419, 537, 538, and 539, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:282, and a light chain variable region having a polypeptide sequence at least 85%, preferably 90%, more preferably 95% or more, such as 95%, 96%, 97%, 98%, or 99% identical to SEQ ID NO:322. Preferably, the isolated monoclonal antibody or antigen-binding fragment thereof comprises a heavy chain variable region having the polypeptide sequence of SEQ ID NO:282; and a light chain variable region having the polypeptide sequence of SEQ ID NO:322.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:420, 421, 422, 540, 541, and 542, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:283, and a light chain variable region having a polypeptide sequence at least 85%, preferably 90%, more preferably 95% or more, such as 95%, 96%, 97%, 98%, or 99% identical to SEQ ID NO:323. Preferably, the isolated monoclonal antibody or antigen-binding fragment thereof comprises a heavy chain variable region having the polypeptide sequence of SEQ ID NO:283; and a light chain variable region having the polypeptide sequence of SEQ ID NO:323.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:423, 424, 425, 543, 544, and 545, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:284, and a light chain variable region having a polypeptide sequence at least 85%, preferably 90%, more preferably 95% or more, such as 95%, 96%, 97%, 98%, or 99% identical to SEQ ID NO:324. Preferably, the isolated monoclonal antibody or antigen-binding fragment thereof comprises a heavy chain variable region having the polypeptide sequence of SEQ ID NO:284; and a light chain variable region having the polypeptide sequence of SEQ ID NO:324.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:426, 427, 428, 546, 547, and 548, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99/a identical to SEQ ID NO:285, and a light chain variable region having a polypeptide sequence at least 85%, preferably 90%, more preferably 95% or more, such as 95%, 96%, 97%, 98%, or 99% identical to SEQ ID NO:325. Preferably, the isolated monoclonal antibody or antigen-binding fragment thereof comprises a heavy chain variable region having the polypeptide sequence of SEQ ID NO:285; and a light chain variable region having the polypeptide sequence of SEQ ID NO:325.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:429, 430, 431, 549, 550, and 551, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:286, and a light chain variable region having a polypeptide sequence at least 85%, preferably 90%, more preferably 95% or more, such as 95%, 96%, 97%, 98%, or 99% identical to SEQ ID NO:326. Preferably, the isolated monoclonal antibody or antigen-binding fragment thereof comprises a heavy chain variable region having the polypeptide sequence of SEQ ID NO:286; and a light chain variable region having the polypeptide sequence of SEQ ID NO:326.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:432, 433, 434, 552, 553, and 554, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:287, and a light chain variable region having a polypeptide sequence at least 85%, preferably 90%, more preferably 95% or more, such as 95%, 96%, 97%, 98%, or 99% identical to SEQ ID NO:327. Preferably, the isolated monoclonal antibody or antigen-binding fragment thereof comprises a heavy chain variable region having the polypeptide sequence of SEQ ID N0:287; and a light chain variable region having the polypeptide sequence of SEQ ID NO:327.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:435, 436, 437, 555, 556, and 557, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:288, and a light chain variable region having a polypeptide sequence at least 85%, preferably 90%, more preferably 95% or more, such as 95%, 96%, 97%, 98%, or 99% identical to SEQ ID NO:328. Preferably, the isolated monoclonal antibody or antigen-binding fragment thereof comprises a heavy chain variable region having the polypeptide sequence of SEQ ID NO:288; and a light chain variable region having the polypeptide sequence of SEQ ID NO:328.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:438, 439, 440, 558, 559, and 560, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:289, and a light chain variable region having a polypeptide sequence at least 85%, preferably 90%, more preferably 95% or more, such as 95%, 96%, 97%, 98%, or 99% identical to SEQ ID NO:329. Preferably, the isolated monoclonal antibody or antigen-binding fragment thereof comprises a heavy chain variable region having the polypeptide sequence of SEQ ID NO:289; and a light chain variable region having the polypeptide sequence of SEQ ID NO:329.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:441, 442, 443, 561, 562, and 563, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:290, and a light chain variable region having a polypeptide sequence at least 85%, preferably 90%, more preferably 95% or more, such as 95%, 96%, 97%, 98%, or 99% identical to SEQ ID NO:330. Preferably, the isolated monoclonal antibody or antigen-binding fragment thereof comprises a heavy chain variable region having the polypeptide sequence of SEQ ID NO:290; and a light chain variable region having the polypeptide sequence of SEQ ID NO:330.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:444, 445, 446, 564, 565, and 566, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:291, and a light chain variable region having a polypeptide sequence at least 85%, preferably 90%, more preferably 95% or more, such as 95%, 96%, 97%, 98%, or 99% identical to SEQ ID NO:331. Preferably, the isolated monoclonal antibody or antigen-binding fragment thereof comprises a heavy chain variable region having the polypeptide sequence of SEQ ID NO:291; and a light chain variable region having the polypeptide sequence of SEQ ID NO:331.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:447, 448, 449, 567, 568, and 569, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:292, and a light chain variable region having a polypeptide sequence at least 85%, preferably 90%, more preferably 95% or more, such as 95%, 96%, 97%, 98%, or 99/a identical to SEQ ID NO:332. Preferably, the isolated monoclonal antibody or antigen-binding fragment thereof comprises a heavy chain variable region having the polypeptide sequence of SEQ ID NO:292; and a light chain variable region having the polypeptide sequence of SEQ ID NO:332.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:450, 451, 452, 570, 571, and 572, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:293, and a light chain variable region having a polypeptide sequence at least 85%, preferably 90%, more preferably 95% or more, such as 95%, 96%, 97%, 98%, or 99% identical to SEQ ID NO:333. Preferably, the isolated monoclonal antibody or antigen-binding fragment thereof comprises a heavy chain variable region having the polypeptide sequence of SEQ ID NO:293; and a light chain variable region having the polypeptide sequence of SEQ ID NO:333.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:453, 454, 455, 573, 574, and 575, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:294, and a light chain variable region having a polypeptide sequence at least 85%, preferably 90%, more preferably 95% or more, such as 95%, 96%, 97%, 98%, or 99% identical to SEQ ID NO:334. Preferably, the isolated monoclonal antibody or antigen-binding fragment thereof comprises a heavy chain variable region having the polypeptide sequence of SEQ ID NO:294; and a light chain variable region having the polypeptide sequence of SEQ ID NO:334.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:456, 457, 458, 576, 577, and 578, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:295, and a light chain variable region having a polypeptide sequence at least 85%, preferably 90%, more preferably 95% or more, such as 95%, 96%, 97%, 98%, or 99% identical to SEQ ID NO:335. Preferably, the isolated monoclonal antibody or antigen-binding fragment thereof comprises a heavy chain variable region having the polypeptide sequence of SEQ ID NO:295; and a light chain variable region having the polypeptide sequence of SEQ ID NO:335.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:459, 460, 461, 579, 580, and 581, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:296, and a light chain variable region having a polypeptide sequence at least 85%, preferably 90%, more preferably 95% or more, such as 95%, 96%, 97%, 98%, or 99% identical to SEQ ID NO:336. Preferably, the isolated monoclonal antibody or antigen-binding fragment thereof comprises a heavy chain variable region having the polypeptide sequence of SEQ ID NO:296; and a light chain variable region having the polypeptide sequence of SEQ ID NO:336.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:378, 379, 380, 582, 583, and 584, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:269, and a light chain variable region having a polypeptide sequence at least 85%, preferably 90%, more preferably 95% or more, such as 95%, 96%, 97%, 98%, or 99% identical to SEQ ID NO:337. Preferably, the isolated monoclonal antibody or antigen-binding fragment thereof comprises a heavy chain variable region having the polypeptide sequence of SEQ ID NO:269; and a light chain variable region having the polypeptide sequence of SEQ ID NO:337.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:414, 415, 416, 585, 586, and 587, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:281, and a light chain variable region having a polypeptide sequence at least 85%, preferably 90%, more preferably 95% or more, such as 95%, 96%, 97%, 98%, or 99% identical to SEQ ID NO:338. Preferably, the isolated monoclonal antibody or antigen-binding fragment thereof comprises a heavy chain variable region having the polypeptide sequence of SEQ ID NO:281; and a light chain variable region having the polypeptide sequence of SEQ ID NO:338.

In one embodiment, the invention relates to an isolated monoclonal antibody or antigen-binding fragment thereof, comprising HCDR1, HCDR2, HCDR3, LCDR1, LCDR2 and LCDR3, having the polypeptide sequences of SEQ ID NOs:429, 430, 431, 480, 481, and 482, respectively. In another embodiment, the isolated monoclonal antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:286, and a light chain variable region having a polypeptide sequence at least 85%, preferably 90%, more preferably 95% or more, such as 95%, 96%, 97%, 98%, or 99/o identical to SEQ ID NO:303. Preferably, the isolated monoclonal antibody or antigen-binding fragment thereof comprises a heavy chain variable region having the polypeptide sequence of SEQ ID NO:286; and a light chain variable region having the polypeptide sequence of SEQ ID NO:303.

Also provided herein are anti-CD33/anti-CD3 bispecific antibodies or antigen-binding fragments thereof comprising an anti-CD33 antibody or an antigen-binding fragment thereof and an anti-CD3 antibody or antigen-binding fragment thereof. In certain embodiments, the anti-CD33 antibody or antigen-binding fragment thereof is an anti-CD33 monoclonal antibody or antigen-binding fragment thereof of the invention and the anti-CD3 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of (1) SEQ ID NOs:342, 343, 344, 465, 466, and 467, respectively, or (2) SEQ ID NOs:345, 346, 347, 468, 469, and 470, respectively.

The term "CD3" refers to the CD3 protein multi-subunit complex. CD3 can also be referred to as "cluster of differentiation 3." The CD3 protein multi-subunit complex is composed of six (6) distinctive polypeptide chains, which include a CD3γ chain (SwissProt P09693) (SEQ ID NO:588), a CD3δ chain (SwissProt P04234) (SEQ ID NO:589), two CD3ε chains (SwissProt P07766) (SEQ ID NO:590), and one CD3ζ chain homodimer (SwissProt 20963) (SEQ ID NO:591), which is associated with the T cell receptor α and β chain. CD3 is a T cell co-receptor that functions to activate both the cytotoxic T cell (CD8+ naïve T cells) and also the T helper cells (CD4+ naïve T cells). The CD3γ, CD3δ, and CD3ε polypeptide chains of the CD3 multi-subunit complex associate with the T-cell receptor (TCR) and the CD3ζ chain to generate an activation signal in T lymphocytes, and the interaction between CD3 and the T-cell receptor constitutes the TCR complex. The term "CD3" includes any CD3 variant, isoform, and species homolog, which is naturally expressed by cells (including T cells) or can be expressed on cells transfected with genes or cDNA encoding those polypeptides, unless noted, preferably the "CD3" is a human CD3 protein multi-subunit complex. The redirection of T-lymphocytes to cancer cells expressing CD33 via the TCR/CD3 complex represents an attractive alternative treatment approach. The TCR/CD3 complex of T-lymphocytes consists of either a TCR alpha (α)/beta (β) or TCR gamma (γ)/delta (6) heterodimer coexpressed at the cell surface with the invariant subunits of CD3 labeled gamma (γ), delta (δ), epsilon (ε), zeta (ζ) and eta (η). Human CD3ε is described under UniProt P07766 (CD3E_HUMAN). An anti CD3ε antibody described in the state of the art is SP34 (Yang S J, The Journal of Immunology (1986) 137: 1097-1100), which reacts with both primate and human CD3 and is available commercially from Pharmingen. Additional anti-CD3 antibodies described in the state of the art include, UCHT-1 (see WO2000041474) and BC-3 (Fred Hutchinson Cancer Research Institute; used in Phase I/II trials of GvHD, Anasetti et al., Transplantation 54: 844 (1992)). SP34 differs from UCHT-1 and BC-3 in that SP-34 recognizes an epitope present on solely the ε chain of CD3 (see Salmeron et al., (1991) J. Immunol. 147: 3047) whereas UCHT-1 and BC-3 recognize an epitope contributed by both the ε and γ chains. Antibody sequences with the same sequence as SP34 are described at least in WO2008119565, WO2008119566, WO2008119567, WO2010037836, WO2010037837 and WO2010037838. An antibody sequence that is 96% identical to the SP34 VH is described in U.S. Pat. No. 8,236,308 (WO2007042261)

Different formats of bispecific antibodies have been described and were recently reviewed by Chames and Baty (2009) Curr Opin Drug Disc Dev 12: 276.

In some embodiments, the bispecific antibody of the present invention is a diabody, a cross-body, or a bispecific antibody obtained via a controlled Fab arm exchange as those described in the present invention.

In some embodiments, the bispecific antibodies include IgG-like molecules with complementary CH3 domains to force heterodimerisation; recombinant IgG-like dual targeting molecules, wherein the two sides of the molecule each contain the Fab fragment or part of the Fab fragment of at least two different antibodies; IgG fusion molecules, wherein full length IgG antibodies are fused to an extra Fab fragment or parts of Fab fragment; Fc fusion molecules, wherein single chain Fv molecules or stabilized diabodies are fused to heavy-chain constant-domains, Fc-regions or parts thereof; Fab fusion molecules, wherein different Fab-fragments are fused together; ScFv- and diabody-based and heavy chain antibodies (e.g., domain antibodies, nanobodies) wherein different single chain Fv molecules or different diabodies or different heavy-chain antibodies (e.g. domain antibodies, nanobodies) are fused to each other or to another protein or carrier molecule.

In some embodiments, IgG-like molecules with complementary CH3 domains molecules include the TRIOMAB™/QUADROMA™ (TRION PHARMA™/FRESENIUS BIOTECH™), the Knobs-into-Holes (GENENTECH®), CrossMAbs (ROCHE®) and the electrostatically-matched (AMGEN®), the LUZ-Y (GENENTECH®), the Strand Exchange Engineered Domain body (SEEDbodyxEMD SERONO®), the BICLONIC™ (MERUS®) and the DUOBODY® (GENMAB® A/S).

In some embodiments, recombinant IgG-like dual targeting molecules include Dual Targeting (DT)-Ig (GSK®/DOMANTIS™), Two-in-one Antibody (GENENTECH®), Cross-linked Mabs (KARMANOS CANCER CENTER®), mAb2 (F-STAR®) and CovX-body (COVX™/PFIZER®).

In some embodiments, IgG fusion molecules include Dual Variable Domain (DVD)-Ig (ABBOTT®), IgG-like Bispecific (InnClone/ELI LILLY®), Ts2Ab (MEDIMMUNE®/ASTRAZENECA®) and BsAb (ZYMOGENETICS®), HERCULES (BIOGEN IDEC™) and TvAb (ROCHE®).

In some embodiments, Fc fusion molecules include to ScFv/Fc Fusions (Academic Institution), SCORPION (EMERGENT BIOSOLUTIONS®/TRUBION™, ZYMOGENETICS®/BRISTOL-MYERS SQUIBB®), Dual Affinity Retargeting Technology (FC-DART®) (MACROGENETICS™) and Dual (ScFv).sub.2-Fab (NATIONAL RESEARCH CENTER FOR ANTIBODY MEDICINE™—China).

In some embodiments, Fab fusion bispecific antibodies include F(ab)2 (MEDAREX™/AMGEN®), Dual-Action or Bis-Fab (GENENTECH®), DOCK-AND-LOCK™ (DNL™) (IMMUNOMEDICS®), Bivalent Bispecific (BIOTECNOL™) and Fab-Fv (UCB-CELLTECH™). ScFv-, diabody-based and domain antibodies include but are not limited to Bispecific T Cell Engager (BiTE) (MICROMET™), Tandem Diabody (TANDAB™) (AFFIRMED™), Dual Affinity Retargeting Technology (DART®) (MACROGENETICS™), Single-chain Diabody (Academic), TCR-like Antibodies (AIT, ReceptorLogics), Human Serum Albumin ScFv Fusion (MERRIMACK™) and COMBODY (EPIGEN BIOTECH®), dual targeting nanobodies (ABLYNX®), dual targeting heavy chain only domain antibodies.

Full length bispecific antibodies of the invention may be generated for example using Fab arm exchange (or half molecule exchange) between two mono specific bivalent antibodies by introducing substitutions at the heavy chain CH3 interface in each half molecule to favor heterodimer formation of two antibody half molecules having distinct specificity either in vitro in cell-free environment or using co-expression. The Fab arm exchange reaction is the result of a disulfide-bond isomerization reaction and dissociation-association of CH3 domains. The heavy-chain disulfide bonds in the hinge regions of the parent mono specific antibodies are reduced. The resulting free cysteines of one of the parent monospecific antibodies form an inter heavy-chain disulfide bond with cysteine residues of a second parent mono specific antibody molecule and simultaneously CH3 domains of the parent antibodies release and reform by dissociation-association. The CH3 domains of the Fab arms may be engineered to favor heterodimerization over homodimerization. The resulting product is a bispecific antibody having two Fab arms or half molecules which each bind a distinct epitope, i.e. an epitope on CD33 and an epitope on CD3.

"Homodimerization" as used herein refers to an interaction of two heavy chains having identical CH3 amino acid sequences. "Homodimer" as used herein refers to an antibody having two heavy chains with identical CH3 amino acid sequences.

"Heterodimerization" as used herein refers to an interaction of two heavy chains having non-identical CH3 amino acid sequences. "Heterodimer" as used herein refers to an antibody having two heavy chains with non-identical CH3 amino acid sequences.

The "knob-in-hole" strategy (see, e.g., PCT Intl. Publ. No. WO 2006/028936) may be used to generate full length bispecific antibodies. Briefly, selected amino acids forming the interface of the CH3 domains in human IgG can be mutated at positions affecting CH3 domain interactions to promote heterodimer formation. An amino acid with a small side chain (hole) is introduced into a heavy chain of an antibody specifically binding a first antigen and an amino acid with a large side chain (knob) is introduced into a heavy chain of an antibody specifically binding a second antigen. After co-expression of the two antibodies, a heterodimer is formed as a result of the preferential interaction of the heavy chain with a "hole" with the heavy chain with a "knob". Exemplary CH3 substitution pairs forming a knob and a hole are (expressed as modified position in the first CH3 domain of the first heavy chain/modified position in the second CH3 domain of the second heavy chain): T366Y/F405A, T366W/F405W, F405W/Y407A, T394W/Y407T, T394S/Y407A, T366W/T394S, F405W/T394S and T366W/T366S_L368A_Y407V.

Other strategies such as promoting heavy chain heterodimerization using electrostatic interactions by substituting positively charged residues at one CH3 surface and negatively charged residues at a second CH3 surface may be used, as described in US Pat. Publ. No. US2010/0015133; US Pat. Publ. No. US2009/0182127; US Pat. Publ. No. US2010/028637 or US Pat. Publ. No. US2011/0123532. In other strategies, heterodimerization may be promoted by the following substitutions (expressed as modified position in the first CH3 domain of the first heavy chain/modified position in the second CH3 domain of the second heavy chain): L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V K409F Y407A/T366A_K409F, or T350V_L351Y_F405A_Y407V/T350V_T366L_K392L_T394W as described in U.S. Pat. Publ. No. US2012/0149876 or U.S. Pat. Publ. No. US2013/0195849.

In addition to methods described above, bispecific antibodies of the invention may be generated in vitro in a cell-free environment by introducing asymmetrical mutations in the CH3 regions of two mono specific homodimeric antibodies and forming the bispecific heterodimeric antibody from two parent monospecific homodimeric antibodies in reducing conditions to allow disulfide bond isomerization according to methods described in Intl. Pat. Publ. No. WO2011/131746. In the methods, the first monospecific bivalent antibody (e.g., anti-CD33 antibody) and the second monospecific bivalent antibody (e.g., anti-CD3 antibody) are engineered to have certain substitutions at the CH3 domain that promotes heterodimer stability; the antibodies are incubated together under reducing conditions sufficient to allow the cysteines in the hinge region to undergo disulfide bond isomerization; thereby generating the bispecific antibody by Fab arm exchange. The incubation conditions may optimally be restored to non-reducing conditions. Exemplary reducing agents that may be used are 2-mercaptoethylamine (2-MEA), dithiothreitol (DTT), dithioerythritol (DTE), glutathione, tris (2-carboxyethyl) phosphine (TCEP), L-cysteine and beta-mercaptoethanol, preferably a reducing agent selected from the group consisting of: 2-mercaptoethylamine, dithiothreitol and tris (2-carboxyethyl) phosphine. For example, incubation for at least 90 min at a temperature of at least 20° C. in the presence of at least 25 mM 2-MEA or in the presence of at least 0.5 mM dithiothreitol at a pH from 5-8, for example at pH of 7.0 or at pH of 7.4 may be used.

In certain embodiments, the anti-CD33 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:

a. SEQ ID NOs:447, 448, 449, 567, 568, and 569, respectively;
b. SEQ ID NOs:444, 445, 446, 564, 565, and 566, respectively;
c. SEQ ID NOs:354, 355, 356, 477, 478, and 479, respectively;
d. SEQ ID NOs:378, 379, 380, 501, 502, and 503, respectively;
e. SEQ ID NOs:411, 412, 413, 531, 532, and 533, respectively;
f. SEQ ID NOs:348, 349, 350, 471, 472, and 473, respectively;
g. SEQ ID NOs:360, 361, 362, 483, 484, and 485, respectively;
h. SEQ ID NOs:363, 364, 365, 486, 487, and 488, respectively;
i. SEQ ID NOs:366, 367, 368, 489, 490, and 491, respectively;
j. SEQ TD NOs:369, 370, 371, 492, 493, and 494, respectively;
k. SEQ ID NOs:387, 388, 389, 492, 493, and 494, respectively;
l. SEQ ID NOs:402, 403, 404, 522, 523, and 524, respectively;
m. SEQ ID NOs:408, 409, 410, 528, 529, and 530, respectively;
n. SEQ ID NOs:423, 424, 425, 543, 544, and 545, respectively;
o. SEQ ID NOs:426, 427, 428, 546, 547, and 548, respectively;
p. SEQ ID NOs:357, 358, 359, 480, 481, and 482, respectively;
q. SEQ ID NOs:372, 373, 374, 495, 496, and 497, respectively;
r. SEQ ID NOs:375, 376, 377, 498, 499, and 500, respectively;
s. SEQ TD NOs:381, 382, 383, 504, 505, and 506, respectively;
t. SEQ ID NOs:384, 385, 386, 507, 508, and 509, respectively;
u. SEQ ID NOs:390, 391, 392, 510, 511, and 512, respectively;
v. SEQ ID NOs:393, 394, 395, 513, 514, and 515, respectively;

w. SEQ ID NOs:396, 397, 398, 516, 517, and 518, respectively;
x. SEQ TD NOs:399, 400, 401, 519, 520, and 521, respectively;
y. SEQ ID NOs:405, 406, 407, 525, 526, and 527, respectively;
z. SEQ ID NOs:414, 415, 416, 534, 535, and 536, respectively;
aa. SEQ ID NOs:417, 418, 419, 537, 538, and 539, respectively;
bb. SEQ ID NOs:420, 421, 422, 540, 541, and 542, respectively;
cc. SEQ ID NOs:429, 430, 431, 549, 550, and 551, respectively;
dd. SEQ ID NOs:432, 433, 434, 552, 553, and 554, respectively;
ee. SEQ ID NOs:435, 436, 437, 555, 556, and 557, respectively;
ff. SEQ ID NOs:438, 439, 440, 558, 559, and 560, respectively;
gg. SEQ ID NOs:441, 442, 443, 561, 562, and 563, respectively;
hh. SEQ ID NOs:450, 451, 452, 570, 571, and 572, respectively;
ii. SEQ ID NOs:453, 454, 455, 573, 574, and 575, respectively;
jj. SEQ ID NOs:456, 457, 458, 576, 577, and 578, respectively;
kk. SEQ ID NOs:459, 460, 461, 579, 580, and 581, respectively;
ll. SEQ ID NOs:378, 379, 380, 582, 583, and 584, respectively;
mm. SEQ ID NOs:414, 415, 416, 585, 586, and 587, respectively; or
nn. SEQ ID NOs:429, 430, 431, 480, 481, and 482, respectively;

and the anti-CD3 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
1) SEQ ID NOs: 342, 343, 344, 465, 466, and 467, respectively; or
2) SEQ ID NOs: 345, 346, 347, 468, 469, and 470, respectively.

In certain embodiments, the anti-CD33 antibody or antigen-binding fragment thereof comprises a heavy chain variable region having a polypeptide sequence at least 85%, preferably 90%, more preferably 95% or more, such as 95%, 96%, 97%, 98%, or 99% identical to one of SEQ ID NOs:259-296, or a light chain variable region having a polypeptide sequence at least 85%, preferably 90%, more preferably 95% or more, such as 95%, 96%, 97%, 98%, or 99% identical to one of SEQ ID NOs:300-338; and the anti-CD3 antibody or antigen-binding fragment thereof comprises a heavy chain variable region having a polypeptide sequence at least 85%, preferably 90%, more preferably 95% or more, such as 95%, 96%, 97%, 98%, or 99% identical to SEQ ID NO:257 or 258, or a light chain variable region having a polypeptide sequence at least 85%, preferably 90°%, more preferably 95% or more, such as 95%, 96%, 97%, 98%, or 99% identical to SEQ ID NO:298 or 299.

In certain embodiments, the anti-CD33/anti-CD3 bispecific antibody or antigen-binding fragment thereof comprises:

a. a heavy chain variable region having the polypeptide sequence of SEQ ID NO:292, and a light chain variable region having the polypeptide sequence of SEQ ID NO:332; and a heavy chain variable region having the polypeptide sequence of SEQ ID NO:257, and a light chain variable region having a polypeptide sequence of SEQ ID NO:298;
b. a heavy chain variable region having the polypeptide sequence of SEQ ID NO:291, and a light chain variable region having the polypeptide sequence of SEQ ID NO:331; and a heavy chain variable region having the polypeptide sequence of SEQ ID NO:257, and a light chain variable region having a polypeptide sequence of SEQ ID NO:298;
c. a heavy chain variable region having the polypeptide sequence of SEQ ID NO:261, and a light chain variable region having the polypeptide sequence of SEQ ID NO:302; and a heavy chain variable region having the polypeptide sequence of SEQ ID NO:257, and a light chain variable region having a polypeptide sequence of SEQ ID NO:298;
d. a heavy chain variable region having the polypeptide sequence of SEQ ID NO:269, and a light chain variable region having the polypeptide sequence of SEQ ID NO:310; and a heavy chain variable region having the polypeptide sequence of SEQ ID NO:257, and a light chain variable region having a polypeptide sequence of SEQ ID NO:298;
e. a heavy chain variable region having the polypeptide sequence of SEQ ID NO:280, and a light chain variable region having the polypeptide sequence of SEQ ID NO:322; and a heavy chain variable region having the polypeptide sequence of SEQ ID NO:257, and a light chain variable region having a polypeptide sequence of SEQ ID NO:298;
f. a heavy chain variable region having the polypeptide sequence of SEQ ID NO:259, and a light chain variable region having the polypeptide sequence of SEQ ID NO:300; and a heavy chain variable region having the polypeptide sequence of SEQ ID NO:257, and a light chain variable region having a polypeptide sequence of SEQ ID NO:298;
g. a heavy chain variable region having the polypeptide sequence of SEQ ID NO:263, and a light chain variable region having the polypeptide sequence of SEQ ID NO:304; and a heavy chain variable region having the polypeptide sequence of SEQ ID NO:257, and a light chain variable region having a polypeptide sequence of SEQ ID NO:298;
h. a heavy chain variable region having the polypeptide sequence of SEQ ID NO:264, and a light chain variable region having the polypeptide sequence of SEQ ID NO:305; and a heavy chain variable region having the polypeptide sequence of SEQ ID NO:257, and a light chain variable region having a polypeptide sequence of SEQ ID NO:298;
i. a heavy chain variable region having the polypeptide sequence of SEQ ID NO:265, and a light chain variable region having the polypeptide sequence of SEQ ID NO:306; and a heavy chain variable region having the polypeptide sequence of SEQ ID NO:257, and a light chain variable region having a polypeptide sequence of SEQ ID NO:298;
j. a heavy chain variable region having the polypeptide sequence of SEQ ID NO:266, and a light chain variable region having the polypeptide sequence of SEQ ID NO:307; and a heavy chain variable region having the polypeptide sequence of SEQ ID NO:257, and a light chain variable region having a polypeptide sequence of SEQ ID NO:298;
k. a heavy chain variable region having the polypeptide sequence of SEQ ID NO:272, and a light chain variable region having the polypeptide sequence of SEQ ID NO:307; and a heavy chain variable region having the polypeptide sequence of SEQ ID NO:257, and a light chain variable region having a polypeptide sequence of SEQ ID NO:298;
l. a heavy chain variable region having the polypeptide sequence of SEQ ID NO:277, and a light chain variable region having the polypeptide sequence of SEQ ID NO:317; and a heavy chain variable region having the polypeptide sequence of SEQ ID NO:257, and a light chain variable region having a polypeptide sequence of SEQ ID NO:298;
m. a heavy chain variable region having the polypeptide sequence of SEQ ID NO:279, and a light chain variable region having the polypeptide sequence of SEQ ID NO:319; and a heavy chain variable region having the polypeptide sequence of SEQ ID NO:257, and a light chain variable region having a polypeptide sequence of SEQ ID NO:298;
n. a heavy chain variable region having the polypeptide sequence of SEQ ID NO:284, and a light chain variable region having the polypeptide sequence of SEQ ID NO:324; and a heavy chain variable region having the polypeptide sequence of SEQ ID NO:257, and a light chain variable region having a polypeptide sequence of SEQ ID NO:298;
o. a heavy chain variable region having the polypeptide sequence of SEQ ID NO:285, and a light chain variable region having the polypeptide sequence of SEQ ID NO:325; and a heavy chain variable region having the polypeptide sequence of SEQ ID NO:257, and a light chain variable region having a polypeptide sequence of SEQ ID NO:298;
p. a heavy chain variable region having the polypeptide sequence of SEQ ID NO:260, and a light chain variable region having the polypeptide sequence of SEQ ID NO:301; and a heavy chain variable region having the polypeptide sequence of SEQ ID NO:257, and a light chain variable region having a polypeptide sequence of SEQ ID NO:298;
q. a heavy chain variable region having the polypeptide sequence of SEQ ID NO:262, and a light chain variable region having the polypeptide sequence of SEQ ID NO:303; and a heavy chain variable region having the polypeptide sequence of SEQ ID NO:257, and a light chain variable region having a polypeptide sequence of SEQ ID NO:298;
r. a heavy chain variable region having the polypeptide sequence of SEQ ID NO:267, and a light chain variable region having the polypeptide sequence of SEQ ID NO:308; and a heavy chain variable region having the polypeptide sequence of SEQ ID NO:257, and a light chain variable region having a polypeptide sequence of SEQ ID NO:298;
s. a heavy chain variable region having the polypeptide sequence of SEQ ID NO:268, and a light chain variable region having the polypeptide sequence of SEQ ID NO:309; and a heavy chain variable region having the polypeptide sequence of SEQ ID NO:257, and a light chain variable region having a polypeptide sequence of SEQ ID NO:298;
t. a heavy chain variable region having the polypeptide sequence of SEQ ID NO:270, and a light chain variable region having the polypeptide sequence of SEQ ID NO:311; and a heavy chain variable region having the polypeptide sequence of SEQ ID NO:257, and a light chain variable region having a polypeptide sequence of SEQ ID NO:298;
u. a heavy chain variable region having the polypeptide sequence of SEQ ID NO:271, and a light chain variable region having the polypeptide sequence of SEQ ID NO:312; and a heavy chain variable region having the polypeptide sequence of SEQ ID NO:257, and a light chain variable region having a polypeptide sequence of SEQ ID NO:298;
v. a heavy chain variable region having the polypeptide sequence of SEQ ID NO:273, and a light chain variable region having the polypeptide sequence of SEQ ID NO:313; and a heavy chain variable region having the polypeptide sequence of SEQ ID NO:257, and a light chain variable region having a polypeptide sequence of SEQ ID NO:298;
w. a heavy chain variable region having the polypeptide sequence of SEQ ID NO:274, and a light chain variable region having the polypeptide sequence of SEQ ID NO:314; and a heavy chain variable region having the polypeptide sequence of SEQ ID NO:257, and a light chain variable region having a polypeptide sequence of SEQ ID NO:298;
x. a heavy chain variable region having the polypeptide sequence of SEQ ID NO:275, and a light chain variable region having the polypeptide sequence of SEQ ID NO:315; and a heavy chain variable region having the polypeptide sequence of SEQ ID NO:257, and a light chain variable region having a polypeptide sequence of SEQ ID NO:298;
y. a heavy chain variable region having the polypeptide sequence of SEQ ID NO:276, and a light chain variable region having the polypeptide sequence of SEQ ID NO:316; and a heavy chain variable region having the polypeptide sequence of SEQ ID NO:257, and a light chain variable region having a polypeptide sequence of SEQ ID NO:298;
z. a heavy chain variable region having the polypeptide sequence of SEQ ID NO:278, and a light chain variable region having the polypeptide sequence of SEQ ID NO:318; and a heavy chain variable region having the polypeptide sequence of SEQ ID NO:257, and a light chain variable region having a polypeptide sequence of SEQ ID NO:298;
aa. a heavy chain variable region having the polypeptide sequence of SEQ ID NO:281, and a light chain variable region having the polypeptide sequence of SEQ ID NO:321; and a heavy chain variable region having the polypeptide sequence of SEQ ID NO:257, and a light chain variable region having a polypeptide sequence of SEQ ID NO:298;
bb. a heavy chain variable region having the polypeptide sequence of SEQ ID NO:282, and a light chain variable region having the polypeptide sequence of SEQ ID NO:322; and a heavy chain variable region having the polypeptide sequence of SEQ ID NO:257, and a light chain variable region having a polypeptide sequence of SEQ ID NO:298;
cc. a heavy chain variable region having the polypeptide sequence of SEQ ID NO:283, and a light chain variable region having the polypeptide sequence of SEQ ID NO:323; and a heavy chain variable region having the polypeptide sequence of SEQ ID NO:257, and a light chain variable region having a polypeptide sequence of SEQ ID NO:298;

dd. a heavy chain variable region having the polypeptide sequence of SEQ ID NO:286, and a light chain variable region having the polypeptide sequence of SEQ ID NO:326; and a heavy chain variable region having the polypeptide sequence of SEQ ID NO:257, and a light chain variable region having a polypeptide sequence of SEQ ID NO:298;

ee. a heavy chain variable region having the polypeptide sequence of SEQ ID NO:287, and a light chain variable region having the polypeptide sequence of SEQ ID NO:327; and a heavy chain variable region having the polypeptide sequence of SEQ ID NO:257, and a light chain variable region having a polypeptide sequence of SEQ ID NO:298;

ff. a heavy chain variable region having the polypeptide sequence of SEQ ID NO:288, and a light chain variable region having the polypeptide sequence of SEQ ID NO:328; and a heavy chain variable region having the polypeptide sequence of SEQ ID NO:257, and a light chain variable region having a polypeptide sequence of SEQ ID NO:298;

gg. a heavy chain variable region having the polypeptide sequence of SEQ ID NO:289, and a light chain variable region having the polypeptide sequence of SEQ ID NO:329; and a heavy chain variable region having the polypeptide sequence of SEQ ID NO:257, and a light chain variable region having a polypeptide sequence of SEQ ID NO:298;

hh. a heavy chain variable region having the polypeptide sequence of SEQ ID NO:290, and a light chain variable region having the polypeptide sequence of SEQ ID NO:330; and a heavy chain variable region having the polypeptide sequence of SEQ ID NO:257, and a light chain variable region having a polypeptide sequence of SEQ ID NO:298;

ii. a heavy chain variable region having the polypeptide sequence of SEQ ID NO:293, and a light chain variable region having the polypeptide sequence of SEQ ID NO:333; and a heavy chain variable region having the polypeptide sequence of SEQ ID NO:257, and a light chain variable region having a polypeptide sequence of SEQ ID NO:298;

jj. a heavy chain variable region having the polypeptide sequence of SEQ ID NO:294, and a light chain variable region having the polypeptide sequence of SEQ ID NO:334; and a heavy chain variable region having the polypeptide sequence of SEQ ID NO:257, and a light chain variable region having a polypeptide sequence of SEQ ID NO:298;

kk. a heavy chain variable region having the polypeptide sequence of SEQ ID NO:295, and a light chain variable region having the polypeptide sequence of SEQ ID NO:335; and a heavy chain variable region having the polypeptide sequence of SEQ ID NO:257, and a light chain variable region having a polypeptide sequence of SEQ ID NO:298;

ll. a heavy chain variable region having the polypeptide sequence of SEQ ID NO:296, and a light chain variable region having the polypeptide sequence of SEQ ID NO:336; and a heavy chain variable region having the polypeptide sequence of SEQ ID NO:257, and a light chain variable region having a polypeptide sequence of SEQ ID NO:298;

mm. a heavy chain variable region having the polypeptide sequence of SEQ ID NO:269, and a light chain variable region having the polypeptide sequence of SEQ ID NO:337; and a heavy chain variable region having the polypeptide sequence of SEQ ID NO:257, and a light chain variable region having a polypeptide sequence of SEQ ID NO:298;

nn. a heavy chain variable region having the polypeptide sequence of SEQ ID NO:281, and a light chain variable region having the polypeptide sequence of SEQ ID NO:338; and a heavy chain variable region having the polypeptide sequence of SEQ ID NO:257, and a light chain variable region having a polypeptide sequence of SEQ ID NO:298;

oo. a heavy chain variable region having the polypeptide sequence of SEQ ID NO:286, and a light chain variable region having the polypeptide sequence of SEQ ID NO:303; and a heavy chain variable region having the polypeptide sequence of SEQ ID NO:257, and a light chain variable region having a polypeptide sequence of SEQ ID NO:298;

pp. a heavy chain variable region having the polypeptide sequence of SEQ ID NO:292, and a light chain variable region having the polypeptide sequence of SEQ ID NO:332; and a heavy chain variable region having the polypeptide sequence of SEQ ID NO:258, and a light chain variable region having a polypeptide sequence of SEQ ID NO:299;

qq. a heavy chain variable region having the polypeptide sequence of SEQ ID NO:291, and a light chain variable region having the polypeptide sequence of SEQ ID NO:331; and a heavy chain variable region having the polypeptide sequence of SEQ ID NO:257, and a light chain variable region having a polypeptide sequence of SEQ ID NO:299;

rr. a heavy chain variable region having the polypeptide sequence of SEQ ID NO:261, and a light chain variable region having the polypeptide sequence of SEQ ID NO:302; and a heavy chain variable region having the polypeptide sequence of SEQ ID NO:258, and a light chain variable region having a polypeptide sequence of SEQ ID NO:299, ss. a heavy chain variable region having the polypeptide sequence of SEQ ID NO:269, and a light chain variable region having the polypeptide sequence of SEQ ID NO:310; and a heavy chain variable region having the polypeptide sequence of SEQ ID NO:258, and a light chain variable region having a polypeptide sequence of SEQ ID NO:299;

tt. a heavy chain variable region having the polypeptide sequence of SEQ ID NO:280, and a light chain variable region having the polypeptide sequence of SEQ ID NO:322; and a heavy chain variable region having the polypeptide sequence of SEQ ID NO:258, and a light chain variable region having a polypeptide sequence of SEQ ID NO:299;

uu. a heavy chain variable region having the polypeptide sequence of SEQ ID NO:259, and a light chain variable region having the polypeptide sequence of SEQ ID NO:300; and a heavy chain variable region having the polypeptide sequence of SEQ ID NO:258, and a light chain variable region having a polypeptide sequence of SEQ ID NO:299;

vv. a heavy chain variable region having the polypeptide sequence of SEQ ID NO:263, and a light chain variable region having the polypeptide sequence of SEQ ID NO:304; and a heavy chain variable region having the polypeptide sequence of SEQ ID NO:258, and a light chain variable region having a polypeptide sequence of SEQ ID NO:299;
ww. a heavy chain variable region having the polypeptide sequence of SEQ ID NO:264, and a light chain variable region having the polypeptide sequence of SEQ ID NO:305; and a heavy chain variable region having the polypeptide sequence of SEQ ID NO:258, and a light chain variable region having a polypeptide sequence of SEQ ID NO:299;
xx. a heavy chain variable region having the polypeptide sequence of SEQ ID NO:265, and a light chain variable region having the polypeptide sequence of SEQ ID NO:306; and a heavy chain variable region having the polypeptide sequence of SEQ ID NO:258, and a light chain variable region having a polypeptide sequence of SEQ ID NO:299,
yy. a heavy chain variable region having the polypeptide sequence of SEQ ID NO:266, and a light chain variable region having the polypeptide sequence of SEQ ID NO:307; and a heavy chain variable region having the polypeptide sequence of SEQ ID NO:258, and a light chain variable region having a polypeptide sequence of SEQ ID NO:299;
zz. a heavy chain variable region having the polypeptide sequence of SEQ ID NO:272, and a light chain variable region having the polypeptide sequence of SEQ ID NO:307; and a heavy chain variable region having the polypeptide sequence of SEQ ID NO:258, and a light chain variable region having a polypeptide sequence of SEQ ID NO:299;
aaa. a heavy chain variable region having the polypeptide sequence of SEQ ID NO:277, and a light chain variable region having the polypeptide sequence of SEQ ID NO:317; and a heavy chain variable region having the polypeptide sequence of SEQ ID NO:258, and a light chain variable region having a polypeptide sequence of SEQ ID NO:299;
bbb. a heavy chain variable region having the polypeptide sequence of SEQ ID NO:279, and a light chain variable region having the polypeptide sequence of SEQ ID NO:319; and a heavy chain variable region having the polypeptide sequence of SEQ ID NO:258, and a light chain variable region having a polypeptide sequence of SEQ ID NO:299;
ccc. a heavy chain variable region having the polypeptide sequence of SEQ ID NO:284, and a light chain variable region having the polypeptide sequence of SEQ ID NO:324; and a heavy chain variable region having the polypeptide sequence of SEQ ID NO:258, and a light chain variable region having a polypeptide sequence of SEQ ID NO:299; or
ddd. a heavy chain variable region having the polypeptide sequence of SEQ ID NO:285, and a light chain variable region having the polypeptide sequence of SEQ ID NO:325; and a heavy chain variable region having the polypeptide sequence of SEQ ID NO:258, and a light chain variable region having a polypeptide sequence of SEQ ID NO:299,
eee. a heavy chain variable region having the polypeptide sequence of SEQ ID NO:260, and a light chain variable region having the polypeptide sequence of SEQ ID NO:301; and a heavy chain variable region having the polypeptide sequence of SEQ ID NO:258, and a light chain variable region having a polypeptide sequence of SEQ ID NO:299;
fff. a heavy chain variable region having the polypeptide sequence of SEQ ID NO:262, and a light chain variable region having the polypeptide sequence of SEQ ID NO:303; and a heavy chain variable region having the polypeptide sequence of SEQ ID NO:258, and a light chain variable region having a polypeptide sequence of SEQ ID NO:299;
ggg. a heavy chain variable region having the polypeptide sequence of SEQ ID NO:267, and a light chain variable region having the polypeptide sequence of SEQ ID NO:308; and a heavy chain variable region having the polypeptide sequence of SEQ ID NO:258, and a light chain variable region having a polypeptide sequence of SEQ ID NO:299;
hhh. a heavy chain variable region having the polypeptide sequence of SEQ ID NO:268, and a light chain variable region having the polypeptide sequence of SEQ ID NO:309; and a heavy chain variable region having the polypeptide sequence of SEQ ID NO:258, and a light chain variable region having a polypeptide sequence of SEQ ID NO:299;
iii. a heavy chain variable region having the polypeptide sequence of SEQ ID NO:270, and a light chain variable region having the polypeptide sequence of SEQ ID NO:311; and a heavy chain variable region having the polypeptide sequence of SEQ ID NO:258, and a light chain variable region having a polypeptide sequence of SEQ ID NO:299;
jjj. a heavy chain variable region having the polypeptide sequence of SEQ ID NO:271, and a light chain variable region having the polypeptide sequence of SEQ ID NO:312; and a heavy chain variable region having the polypeptide sequence of SEQ ID NO:258, and a light chain variable region having a polypeptide sequence of SEQ ID NO:299,
kkk. a heavy chain variable region having the polypeptide sequence of SEQ ID NO:273, and a light chain variable region having the polypeptide sequence of SEQ ID NO:313; and a heavy chain variable region having the polypeptide sequence of SEQ ID NO:258, and a light chain variable region having a polypeptide sequence of SEQ ID NO:299;
lll. a heavy chain variable region having the polypeptide sequence of SEQ ID NO:274, and a light chain variable region having the polypeptide sequence of SEQ ID NO:314; and a heavy chain variable region having the polypeptide sequence of SEQ ID NO:258, and a light chain variable region having a polypeptide sequence of SEQ ID NO:299;
mmm. a heavy chain variable region having the polypeptide sequence of SEQ ID NO:275, and a light chain variable region having the polypeptide sequence of SEQ ID NO:315; and a heavy chain variable region having the polypeptide sequence of SEQ ID NO:258, and a light chain variable region having a polypeptide sequence of SEQ ID NO:299;
nnn. a heavy chain variable region having the polypeptide sequence of SEQ ID NO:276, and a light chain variable region having the polypeptide sequence of SEQ ID NO:316; and a heavy chain variable region having the polypeptide sequence of SEQ ID NO:258, and a light chain variable region having a polypeptide sequence of SEQ ID NO:299;
ooo. a heavy chain variable region having the polypeptide sequence of SEQ ID NO:278, and a light chain variable region having the polypeptide sequence of SEQ ID NO:318; and a heavy chain variable region having the polypeptide sequence of SEQ ID NO:258, and a light chain variable region having a polypeptide sequence of SEQ ID NO:299;
ppp. a heavy chain variable region having the polypeptide sequence of SEQ ID NO:281, and a light chain variable region having the polypeptide sequence of SEQ ID NO:321; and a heavy chain variable region having the polypeptide sequence of SEQ ID NO:258, and a light chain variable region having a polypeptide sequence of SEQ ID NO:299,
qqq. a heavy chain variable region having the polypeptide sequence of SEQ ID NO:282, and a light chain variable region having the polypeptide sequence of SEQ ID NO:322; and a heavy chain variable region having the polypeptide sequence of SEQ ID NO:258, and a light chain variable region having a polypeptide sequence of SEQ ID NO:299;
rrr. a heavy chain variable region having the polypeptide sequence of SEQ ID NO:283, and a light chain variable region having the polypeptide sequence of SEQ ID NO:323; and a heavy chain variable region having the polypeptide sequence of SEQ ID NO:258, and a light chain variable region having a polypeptide sequence of SEQ ID NO:299;
sss. a heavy chain variable region having the polypeptide sequence of SEQ ID NO:286, and a light chain variable region having the polypeptide sequence of SEQ ID NO:326; and a heavy chain variable region having the polypeptide sequence of SEQ ID NO:258, and a light chain variable region having a polypeptide sequence of SEQ ID NO:299;
ttt. a heavy chain variable region having the polypeptide sequence of SEQ ID NO:287, and a light chain variable region having the polypeptide sequence of SEQ ID NO:327; and a heavy chain variable region having the polypeptide sequence of SEQ ID NO:258, and a light chain variable region having a polypeptide sequence of SEQ ID NO:299;
uuu. a heavy chain variable region having the polypeptide sequence of SEQ ID NO:288, and a light chain variable region having the polypeptide sequence of SEQ ID NO:328; and a heavy chain variable region having the polypeptide sequence of SEQ ID NO:258, and a light chain variable region having a polypeptide sequence of SEQ ID NO:299;
vvv. a heavy chain variable region having the polypeptide sequence of SEQ ID NO:289, and a light chain variable region having the polypeptide sequence of SEQ ID NO:329; and a heavy chain variable region having the polypeptide sequence of SEQ ID NO:258, and a light chain variable region having a polypeptide sequence of SEQ ID NO:299,
www. a heavy chain variable region having the polypeptide sequence of SEQ ID NO:290, and a light chain variable region having the polypeptide sequence of SEQ ID NO:330; and a heavy chain variable region having the polypeptide sequence of SEQ ID NO:258, and a light chain variable region having a polypeptide sequence of SEQ ID NO:299;
xxx. a heavy chain variable region having the polypeptide sequence of SEQ ID NO:293, and a light chain variable region having the polypeptide sequence of SEQ ID NO:333; and a heavy chain variable region having the polypeptide sequence of SEQ ID NO:258, and a light chain variable region having a polypeptide sequence of SEQ ID NO:299;
yyy. a heavy chain variable region having the polypeptide sequence of SEQ ID NO:294, and a light chain variable region having the polypeptide sequence of SEQ ID NO:334; and a heavy chain variable region having the polypeptide sequence of SEQ ID NO:258, and a light chain variable region having a polypeptide sequence of SEQ ID NO:299;
zzz. a heavy chain variable region having the polypeptide sequence of SEQ ID NO:295, and a light chain variable region having the polypeptide sequence of SEQ ID NO:335; and a heavy chain variable region having the polypeptide sequence of SEQ ID NO:258, and a light chain variable region having a polypeptide sequence of SEQ ID NO:299;
aaaa. a heavy chain variable region having the polypeptide sequence of SEQ ID NO:296, and a light chain variable region having the polypeptide sequence of SEQ ID NO:336; and a heavy chain variable region having the polypeptide sequence of SEQ ID NO:258, and a light chain variable region having a polypeptide sequence of SEQ ID NO:299;
bbbb. a heavy chain variable region having the polypeptide sequence of SEQ ID NO:269, and a light chain variable region having the polypeptide sequence of SEQ ID NO:337; and a heavy chain variable region having the polypeptide sequence of SEQ ID NO:258, and a light chain variable region having a polypeptide sequence of SEQ ID NO:299,
cccc. a heavy chain variable region having the polypeptide sequence of SEQ ID NO:281, and a light chain variable region having the polypeptide sequence of SEQ ID NO:338; and a heavy chain variable region having the polypeptide sequence of SEQ ID NO:258, and a light chain variable region having a polypeptide sequence of SEQ ID NO:299; or
dddd. a heavy chain variable region having the polypeptide sequence of SEQ ID NO:286, and a light chain variable region having the polypeptide sequence of SEQ ID NO:303; and a heavy chain variable region having the polypeptide sequence of SEQ ID NO:258, and a light chain variable region having a polypeptide sequence of SEQ ID NO:299.

According to another particular aspect, the invention relates to an isolated anti-CD33 monoclonal antibody or antigen-binding fragment thereof that induces antibody-dependent cell-mediated cytotoxicity (ADCC). The monoclonal antibody or antigen-binding fragment thereof can, for example, induce ADCC in vitro. The monoclonal antibody or antigen-binding fragment thereof can induce ADCC with an $EC_{50}$ of less than about 2 nM. In certain embodiments, the $EC_{50}$ is less than about 2.0 nM, less than about 1.9 nM, less than about 1.8 nM, less than about 1.7 nM, less than about 1.6 nM, less than about 1.5 nM, less than about 1.4 nM, less than about 1.3 nM, less than about 1.2 nM, less than about 1.1 nM, less than about 1.0 nM, less than about 0.9 nM, less than about 0.8 nM, less than about 0.7 nM, less than about 0.6 nM, less than about 0.5 nM, less than about 0.4 nM, less than about 0.3 nM, less than about 0.2 nM, or less than about 0.1 nM. In certain embodiments, the CD33 monoclonal antibody or antigen-binding fragment thereof comprises an IgG1 low fucose backbone.

In some embodiments described herein, immune effector properties of the CD33-specific antibodies can be enhanced or silenced through Fc modifications by techniques known to those skilled in the art. For example, Fc effector functions such as Clq binding, complement dependent cytotoxicity (CDC), antibody-dependent cell-mediated cytotoxicity (ADCC), antibody-dependent cell-mediated phagocytosis (ADCP), down regulation of cell surface receptors (e.g., B cell receptor; BCR), etc. may be provided and/or controlled by modifying residues in the Fc responsible for these activities.

"Antibody-dependent cell-mediated cytotoxicity" or "ADCC" refers to a cell-mediated reaction in which non-specific cytotoxic cells that express Fc receptors (FcRs) (e.g. Natural Killer (NK) cells, neutrophils, and macrophages) recognize bound antibody on a target cell and subsequently cause lysis of the target cell.

The ability of monoclonal antibodies to induce ADCC can be enhanced by engineering their oligosaccharide component. Human IgG1 or IgG3 are N-glycosylated at Asn297 with the majority of the glycans in the well-known biantennary G0, G0F, G1, G1F, G2 or G2F forms. Antibodies produced by non-engineered CHO cells typically have a glycan fucose content of about at least 85%. The removal of the core fucose from the biantennary complex-type oligo-saccharides attached to the Fc regions enhances the ADCC of antibodies via improved Fc.gamma.RIIIa binding without altering antigen binding or CDC activity. Such mAbs can be achieved using different methods reported to lead to the successful expression of relatively high defucosylated antibodies bearing the biantennary complex-type of Fc oligo-saccharides such as control of culture osmolality (Konno et al., Cytotechnology 64:249-65, 2012), application of a variant CHO line Lec13 as the host cell line (Shields et al., J Biol Chem 277:26733-26740, 2002), application of a variant CHO line EB66 as the host cell line (Olivier et al., MAbs; 2(4), 2010; Epub ahead of print; PMID:20562582), application of a rat hybridoma cell line YB2/0 as the host cell line (Shinkawa et al., J Biol Chem 278:3466-3473, 2003), introduction of small interfering RNA specifically against the α-1,6-fucosyltrasferase (FUT8) gene (Mori et al., Biotechnol Bioeng 88:901-908, 2004), or coexpression of β-1,4-N-acetylglucosaminyltransferase III and golgi α-mannosidase II or a potent alpha-mannosidase I inhibitor, kifunensine (Ferrara et al., J Biol Chem 281:5032-5036, 2006, Ferrara et al., Biotechnol Bioeng 93:851-861, 2006; Xhou et al., Biotechnol Bioeng 99:652-65, 2008).

In some embodiments described herein, ADCC elicited by the CD33 antibodies may also be enhanced by certain substitutions in the antibody Fc. Exemplary substitutions are for example substitutions at amino acid positions 256, 290, 298, 312, 356, 330, 333, 334, 360, 378 or 430 (residue numbering according to the EU index) as described in U.S. Pat. No. 6,737,056.

According to another particular aspect, the invention relates to an isolated anti-CD33 monoclonal antibody or antigen-binding fragment thereof that is capable of binding CD33 with a dissociation constant (KD) of less than about $5 \times 10^{-8}$ M. In certain embodiments, the dissociation constant is less than about $5 \times 10^{-8}$ M, less than $1 \times 10^{-8}$ M, less than $5 \times 10^{-9}$ M, less than $1 \times 10^{-9}$ M, less than $5 \times 10^{-10}$ M, less than $1 \times 10^{-10}$ M, less than $5 \times 10^{-11}$ M, or less than $1 \times 10^{-11}$ M.

According to another particular aspect, the invention relates to an isolated anti-CD33 monoclonal antibody or antigen-binding fragment thereof that is capable of binding CD33 and inducing internalization of CD33 with an $EC_{50}$ of less than about 2 nM. In certain embodiments, the $EC_{50}$ is less than about 2.0 nM, less than about 1.9 nM, less than about 1.8 nM, less than about 1.7 nM, less than about 1.6 nM, less than about 1.5 nM, less than about 1.4 nM, less than about 1.3 nM, less than about 1.2 nM, less than about 1.1 nM, less than about 1.0 nM, less than about 0.9 nM, less than about 0.8 nM, less than about 0.7 nM, less than about 0.6 nM, less than about 0.5 nM, less than about 0.4 nM, less than about 0.3 nM, less than about 0.2 nM, and less than about 0.1 nM.

According to another particular aspect, the invention relates to an isolated anti-CD33/anti-CD3 bispecific antibody or antigen-binding fragment thereof capable of inducing T-cell dependent cytotoxicity in CD33-expressing cells. The bispecific antibody or antigen-binding fragment thereof can, for example, induce T-cell dependent cytotoxicity in CD33-expressing cells in vitro with an $EC_{50}$ value of less than about 2 nM. In certain embodiments, the $EC_{50}$ is less than about 2.0 nM, less than about 1.9 nM, less than about 1.8 nM, less than about 1.7 nM, less than about 1.6 nM, less than about 1.5 nM, less than about 1.4 nM, less than about 1.3 nM, less than about 1.2 nM, less than about 1.1 nM, less than about 1.0 nM, less than about 0.9 nM, less than about 0.8 nM, less than about 0.7 nM, less than about 0.6 nM, less than about 0.5 nM, less than about 0.4 nM, less than about 0.3 nM, less than about 0.2 nM, and less than about 0.1 nM.

According to another particular aspect, the invention relates to an isolated anti-CD33 monoclonal antibody and/or an isolated anti-CD33/anti-CD3 bispecific antibody or antigen-binding fragment thereof, wherein the anti-CD33 monoclonal antibody or anti-CD33/anti-CD3 bispecific antibody or antigen-binding fragment thereof is chimeric.

According to another particular aspect, the invention relates to an isolated anti-CD33 monoclonal antibody and/or an isolated anti-CD33/anti-CD3 bispecific antibody or antigen-binding fragment thereof, wherein the anti-CD33 monoclonal antibody or anti-CD33/anti-CD3 bispecific antibody or antigen-binding fragment thereof is human or humanized.

In another general aspect, the invention relates to an isolated nucleic acid encoding a monoclonal antibody or antigen-binding fragment thereof of the invention. In another general aspect, the invention relates to an isolated nucleic acid encoding a bispecific antibody or antigen-binding fragment thereof of the invention. It will be appreciated by those skilled in the art that the coding sequence of a protein can be changed (e.g., replaced, deleted, inserted, etc.) without changing the amino acid sequence of the protein. Accordingly, it will be understood by those skilled in the art that nucleic acid sequences encoding monoclonal antibodies and/or bispecific antibodies of the invention can be altered without changing the amino acid sequences of the proteins.

In another general aspect, the invention relates to a vector comprising an isolated nucleic acid encoding a monoclonal antibody or antigen-binding fragment thereof of the invention. In another general aspect, the invention relates to a vector comprising an isolated nucleic acid encoding a bispecific antibody or antigen-binding fragment thereof of the invention. Any vector known to those skilled in the art in view of the present disclosure can be used, such as a plasmid, a cosmid, a phage vector or a viral vector. In some embodiments, the vector is a recombinant expression vector such as a plasmid. The vector can include any element to establish a conventional function of an expression vector, for example, a promoter, ribosome binding element, terminator, enhancer, selection marker, and origin of replication. The promoter can be a constitutive, inducible or repressible promoter. A number of expression vectors capable of delivering nucleic acids to a cell are known in the art and can be used herein for production of an antibody or antigen-binding fragment thereof in the cell. Conventional cloning techniques or artificial gene synthesis can be used to generate a recombinant expression vector according to embodiments of the invention. Such techniques are well known to those skilled in the art in view of the present disclosure.

In another general aspect, the invention relates to a host cell comprising an isolated nucleic acid encoding a monoclonal antibody and/or bispecific antibody or an antigen-binding fragment thereof of the invention. Any host cell known to those skilled in the art in view of the present disclosure can be used for recombinant expression of antibodies or antigen-binding fragments thereof of the invention. In some embodiments, the host cells are E. coli TG1 or BL21 cells (for expression of, e.g., an scFv or Fab antibody), CHO-DG44 or CHO-K1 cells or HEK293 cells (for expression of, e.g., a full-length IgG antibody). According to particular embodiments, the recombinant expression vector is transformed into host cells by conventional methods such as chemical transfection, heat shock, or electroporation, where it is stably integrated into the host cell genome such that the recombinant nucleic acid is effectively expressed.

In another general aspect, the invention relates to a method of producing a monoclonal antibody or antigen-binding fragment thereof of the invention, comprising culturing a cell comprising a nucleic acid encoding the monoclonal antibody or antigen-binding fragment thereof under conditions to produce a monoclonal antibody or antigen-binding fragment thereof of the invention, and recovering the antibody or antigen-binding fragment thereof from the cell or cell culture (e.g., from the supernatant). In another general aspect, the invention relates to a method of producing a bispecific antibody or antigen-binding fragment thereof of the invention, comprising culturing a cell comprising a nucleic acid encoding the bispecific antibody or antigen-binding fragment thereof under conditions to produce a bispecific antibody or antigen-binding fragment thereof of the invention, and recovering the antibody or antigen-binding fragment thereof from the cell or cell culture (e.g., from the supernatant). Expressed antibodies or antigen-binding fragments thereof can be harvested from the cells and purified according to conventional techniques known in the art and as described herein.

Pharmaceutical Compositions

In another general aspect, the invention relates to a pharmaceutical composition comprising an isolated monoclonal antibody or antigen-binding fragment thereof of the invention and a pharmaceutically acceptable carrier. In another general aspect, the invention relates to a pharmaceutical composition comprising a bispecific antibody or antigen-binding fragment thereof of the invention and a pharmaceutically acceptable carrier. The term "pharmaceutical composition" as used herein means a product comprising an antibody of the invention together with a pharmaceutically acceptable carrier. Antibodies of the invention and compositions comprising them are also useful in the manufacture of a medicament for therapeutic applications mentioned herein.

As used herein, the term "carrier" refers to any excipient, diluent, filler, salt, buffer, stabilizer, solubilizer, oil, lipid, lipid containing vesicle, microsphere, liposomal encapsulation, or other material well known in the art for use in pharmaceutical formulations. It will be understood that the characteristics of the carrier, excipient or diluent will depend on the route of administration for a particular application. As used herein, the term "pharmaceutically acceptable carrier" refers to a non-toxic material that does not interfere with the effectiveness of a composition according to the invention or the biological activity of a composition according to the invention. According to particular embodiments, in view of the present disclosure, any pharmaceutically acceptable carrier suitable for use in an antibody pharmaceutical composition can be used in the invention.

The formulation of pharmaceutically active ingredients with pharmaceutically acceptable carriers is known in the art, e.g., Remington: The Science and Practice of Pharmacy (e.g. 21st edition (2005), and any later editions). Non-limiting examples of additional ingredients include; buffers, diluents, solvents, tonicity regulating agents, preservatives, stabilizers, and chelating agents. One or more pharmaceutically acceptable carrier may be used in formulating the pharmaceutical compositions of the invention.

In one embodiment of the invention, the pharmaceutical composition is a liquid formulation. A preferred example of a liquid formulation is an aqueous formulation, i.e., a formulation comprising water. The liquid formulation may comprise a solution, a suspension, an emulsion, a microemulsion, a gel, and the like. An aqueous formulation typically comprises at least 50% w/w water, or at least 60%, 70%, 75%, 80%, 85%, 90%, or at least 95% w/w of water.

In one embodiment, the pharmaceutical composition may be formulated as an injectable which can be injected, for example, via an injection device (e.g., a syringe or an infusion pump). The injection may be delivered subcutaneously, intramuscularly, intraperitoneally, intravitreally, or intravenously, for example.

In another embodiment, the pharmaceutical composition is a solid formulation, e.g., a freeze-dried or spray-dried composition, which may be used as is, or whereto the physician or the patient adds solvents, and/or diluents prior to use. Solid dosage forms may include tablets, such as compressed tablets, and/or coated tablets, and capsules (e.g., hard or soft gelatin capsules). The pharmaceutical composition may also be in the form of sachets, dragees, powders, granules, lozenges, or powders for reconstitution, for example.

The dosage forms may be immediate release, in which case they may comprise a water-soluble or dispersible carrier, or they may be delayed release, sustained release, or modified release, in which case they may comprise water-insoluble polymers that regulate the rate of dissolution of the dosage form in the gastrointestinal tract or under the skin.

In other embodiments, the pharmaceutical composition may be delivered intranasally, intrabuccally, or sublingually.

The pH in an aqueous formulation can be between pH 3 and pH 10. In one embodiment of the invention, the pH of the formulation is from about 7.0 to about 9.5. In another embodiment of the invention, the pH of the formulation is from about 3.0 to about 7.0.

In another embodiment of the invention, the pharmaceutical composition comprises a buffer. Non-limiting examples of buffers include: arginine, aspartic acid, bicine, citrate, disodium hydrogen phosphate, fumaric acid, glycine, glycylglycine, histidine, lysine, maleic acid, malic acid, sodium acetate, sodium carbonate, sodium dihydrogen phosphate, sodium phosphate, succinate, tartaric acid, tricine, and tris(hydroxymethyl)-aminomethane, and mixtures thereof. The buffer may be present individually or in the aggregate, in a concentration from about 0.01 mg/ml to about 50 mg/ml, for example from about 0.1 mg/ml to about 20 mg/ml. Pharmaceutical compositions comprising each one of these specific buffers constitute alternative embodiments of the invention.

In another embodiment of the invention, the pharmaceutical composition comprises a preservative. Non-limiting examples of buffers include: benzethonium chloride, benzoic acid, benzyl alcohol, bronopol, butyl 4-hydroxybenzoate, chlorobutanol, chlorocresol, chlorohexidine, chlorphenesin, o-cresol, m-cresol, p-cresol, ethyl 4-hydroxybenzoate, imidurea, methyl 4-hydroxybenzoate, phenol, 2-phenoxyethanol, 2-phenylethanol, propyl 4-hydroxybenzoate, sodium dehydroacetate, thiomerosal, and mixtures thereof. The preservative may be present individually or in the aggregate, in a concentration from about 0.01 mg/ml to about 50 mg/ml, for example from about 0.1 mg/ml to about 20 mg/ml. Pharmaceutical compositions comprising each one of these specific preservatives constitute alternative embodiments of the invention.

In another embodiment of the invention, the pharmaceutical composition comprises an isotonic agent. Non-limiting examples of the embodiment include a salt (such as sodium chloride), an amino acid (such as glycine, histidine, arginine, lysine, isoleucine, aspartic acid, tryptophan, and threonine), an alditol (such as glycerol, 1,2-propanediol propylenegylcol), 1,3-propanediol, and 1,3-butanediol), polyethylenegylcol (e.g. PEG400), and mixtures thereof. Another example of an isotonic agent includes a sugar. Non-limiting examples of sugars may be mono-, di-, or polysaccharides, or water-soluble glucans, including for example fructose, glucose, mannose, sorbose, xylose, maltose, lactose, sucrose, trehalose, dextran, pullulan, dextrin, cyclodextrin, alpha and beta-HPCD, soluble starch, hydroxyethyl starch, and sodium carboxymethyl-cellulose. Another example of an isotonic agent is a sugar alcohol, wherein the term "sugar alcohol" is defined as a C(4-8) hydrocarbon having at least one —OH group. Non-limiting examples of sugar alcohols include mannitol, sorbitol, inositol, galactitol, dulcitol, xylitol, and arabitol. Pharmaceutical compositions comprising each isotonic agent listed in this paragraph constitute alternative embodiments of the invention. The isotonic agent may be present individually or in the aggregate, in a concentration from about 0.01 mg/ml to about 50 mg/ml, for example from about 0.1 mg/ml to about 20 mg/ml. Pharmaceutical compositions comprising each one of these specific isotonic agents constitute alternative embodiments of the invention.

In another embodiment of the invention, the pharmaceutical composition comprises a chelating agent. Non-limiting examples of chelating agents include citric acid, aspartic acid, salts of ethylenediaminetetraacetic acid (EDTA), and mixtures thereof. The chelating agent may be present individually or in the aggregate, in a concentration from about 0.01 mg/ml to about 50 mg/ml, for example from about 0.1 mg/ml to about 20 mg/ml. Pharmaceutical compositions comprising each one of these specific chelating agents constitute alternative embodiments of the invention.

In another embodiment of the invention, the pharmaceutical composition comprises a stabilizer. Non-limiting examples of stabilizers include one or more aggregation inhibitors, one or more oxidation inhibitors, one or more surfactants, and/or one or more protease inhibitors.

In another embodiment of the invention, the pharmaceutical composition comprises a stabilizer, wherein said stabilizer is carboxy-/hydroxycellulose and derivates thereof (such as HPC, HPC-SL, HPC-L and HPMC), cyclodextrins, 2-methylthioethanol, polyethylene glycol (such as PEG 3350), polyvinyl alcohol (PVA), polyvinyl pyrrolidone, salts (such as sodium chloride), sulphur-containing substances such as monothioglycerol), or thioglycolic acid. The stabilizer may be present individually or in the aggregate, in a concentration from about 0.01 mg/ml to about 50 mg/ml, for example from about 0.1 mg/ml to about 20 mg/ml. Pharmaceutical compositions comprising each one of these specific stabilizers constitute alternative embodiments of the invention.

In further embodiments of the invention, the pharmaceutical composition comprises one or more surfactants, preferably a surfactant, at least one surfactant, or two different surfactants. The term "surfactant" refers to any molecules or ions that are comprised of a water-soluble (hydrophilic) part, and a fat-soluble (lipophilic) part. The surfactant may, for example, be selected from the group consisting of anionic surfactants, cationic surfactants, nonionic surfactants, and/or zwitterionic surfactants. The surfactant may be present individually or in the aggregate, in a concentration from about 0.1 mg/ml to about 20 mg/ml. Pharmaceutical compositions comprising each one of these specific surfactants constitute alternative embodiments of the invention.

In a further embodiment of the invention, the pharmaceutical composition comprises one or more protease inhibitors, such as, e.g., EDTA, and/or benzamidine hydrochloric acid (HCl). The protease inhibitor may be present individually or in the aggregate, in a concentration from about 0.1 mg/ml to about 20 mg/ml. Pharmaceutical compositions comprising each one of these specific protease inhibitors constitute alternative embodiments of the invention.

In another general aspect, the invention relates to a method of producing a pharmaceutical composition comprising a monoclonal antibody or antigen-binding fragment thereof of the invention, comprising combining a monoclonal antibody or antigen-binding fragment thereof with a pharmaceutically acceptable carrier to obtain the pharmaceutical composition. In another general aspect, the invention relates to a method of producing a pharmaceutical composition comprising a bispecific antibody or antigen-binding fragment thereof of the invention, comprising combining a bispecific antibody or antigen-binding fragment thereof with a pharmaceutically acceptable carrier to obtain the pharmaceutical composition.

Methods of Use

In another general aspect, the invention relates to a method of targeting CD33 on a cancer cell surface in a subject, the method comprising administering to the subject an isolated monoclonal antibody or antigen binding fragment thereof that specifically binds CD33 or an anti-CD33/anti-CD3 bispecific antibody or antigen binding fragment thereof or a pharmaceutical composition of the invention.

Also contemplated herein is a therapeutic anti-CD33 antibody immunoconjugate comprising a therapeutic agent that is selected from the group consisting of a radionuclide, boron, gadolinium or uranium atoms, an immunomodulator, such as a cytokine, a stem cell growth factor, a lymphotoxin, such as tumor necrosis factor (TNF), a hematopoietic factor such as an interleukin (IL), a colony stimulating factor (CSF) such as granulocyte-colony stimulating factor (G-CSF) or granulocyte macrophage-colony stimulating factor (GM-CSF)), an interferon (IFN) such as interferons-α, -β or -γ, and a stem cell growth factor such as that designated "S1 factor," a hematopoietic factor, erythropoietin, thrombopoietin, an antibody, a hormone, a hormone antagonist, an enzyme, an enzyme inhibitor, a photoactive therapeutic agent, a cytotoxic drug, such as antimitotic agents, alkylating agents, antimetabolite agents, angiogenesis-inhibiting agents, apoptotic agents, alkaloid agents, COX-2-inhibiting agents, and antibiotic agents, a cytotoxic toxin, such as plant toxins, microbial toxins, and animal toxins, and synthetic variations thereof, an angiogenesis inhibitor, a different antibody, and a combination thereof. In a preferred embodiment, the cytokine is selected from the group consisting of IL-1, IL-2, IL-3, IL-6, IL-10, IL-12, IL-18, IL-21, interferon-γ, TNF-α and a combination thereof, the radionuclide is selected from the group consisting of an Auger emitter, a beta-emitter and an alpha-emitter, such as P-32, P-33, Sc-47, Fe-59, Cu-64, Cu-67, Se-75, As-77, Sr-89, Y-90, Mo-99, Rh-105, Pd-109, Ag-111, I-125, I-131, Pr-142, Pr-143, Pm-149, Sm-153, Tb-161, Ho-166, Er-169, Lu-177, Re-186, Re-188, Re-189, Ir-194, Au-198, Au-199, Pb-211, Pb-212, and Bi-213, Co-58, Ga-67, Br-80m, Tc-99m, Rh-103m, Pt-109, In-111, Sb-119, I-125, Ho-161, Os-189m, Ir-192, Dy-152, At-211, Bi-212, Ra-223, Rn-219, Po-215, Bi-211, Ac-225, Fr-221, At-217, Bi-213, Fm-255, B-10, Gd-157, U-235, and combinations thereof. Preferably, the radionuclide has an energy between 20 and 10,000 keV.

The functional activity of antibodies and antigen-binding fragments thereof that bind CD33 can be characterized by methods known in the art and as described herein. Methods for characterizing antibodies and antigen-binding fragments thereof that bind CD33 include, but are not limited to, affinity and specificity assays including BIACORE®, ELISA, and OCTET® Red analysis; binding assays to detect the binding of antibodies to CD33 on cancer cells by FACS. According to particular embodiments, the methods for characterizing antibodies and antigen-binding fragments thereof that bind CD33 include those described below.

In another general aspect, the invention relates to a method of treating a cancer in a subject in need thereof, comprising administering to the subject an isolated monoclonal antibody or antigen binding fragment thereof that specifically binds CD33 or a pharmaceutical composition of the invention. The cancer can, for example, be a CD33-expressing cancer. The cancer can, for example, be selected from but not limited to, a lung cancer, a gastric cancer, a colon cancer, a hepatocellular carcinoma, a renal cell carcinoma, a bladder urothelial carcinoma, a metastatic melanoma, a breast cancer, an ovarian cancer, a cervical cancer, a head and neck cancer, a pancreatic cancer, a glioma, a glioblastoma, and other solid tumors, and a non-Hodgkin's lymphoma (NHL), an acute lymphocytic leukemia (ALL), a chronic lymphocytic leukemia (CLL), a chronic myelogenous leukemia (CML), a multiple myeloma (MM), an acute myeloid leukemia (AML), and other liquid tumors. The cancer can, for example, be a hematologic cancer. The hematologic cancer can, for example, be a leukemia, a lymphoma, and a myeloma. In certain embodiments, the hematologic cancer can be acute myeloid leukemia (AML), myelodysplastic syndrome (MDS, low or high risk), acute lymphocytic leukemia (ALL, including all subtypes), diffuse large B-cell lymphoma (DLBCL), chronic myeloid leukemia (CML), or blastic plasmacytoid dendritic cell neoplasm (DPDCN).

According to embodiments of the invention, the pharmaceutical composition comprises a therapeutically effective amount of an anti-CD33 antibody or antigen-binding fragment thereof. As used herein, the term "therapeutically effective amount" refers to an amount of an active ingredient or component that elicits the desired biological or medicinal response in a subject. A therapeutically effective amount can be determined empirically and in a routine manner, in relation to the stated purpose.

As used herein with reference to anti-CD33 antibodies or antigen-binding fragments thereof, a therapeutically effective amount means an amount of the anti-CD33 antibody or antigen-binding fragment thereof that modulates an immune response in a subject in need thereof.

According to particular embodiments, a therapeutically effective amount refers to the amount of therapy which is sufficient to achieve one, two, three, four, or more of the following effects: (i) reduce or ameliorate the severity of the disease, disorder or condition to be treated or a symptom associated therewith; (ii) reduce the duration of the disease, disorder or condition to be treated, or a symptom associated therewith; (iii) prevent the progression of the disease, disorder or condition to be treated, or a symptom associated therewith; (iv) cause regression of the disease, disorder or condition to be treated, or a symptom associated therewith; (v) prevent the development or onset of the disease, disorder or condition to be treated, or a symptom associated therewith; (vi) prevent the recurrence of the disease, disorder or condition to be treated, or a symptom associated therewith; (vii) reduce hospitalization of a subject having the disease, disorder or condition to be treated, or a symptom associated therewith; (viii) reduce hospitalization length of a subject having the disease, disorder or condition to be treated, or a symptom associated therewith; (ix) increase the survival of a subject with the disease, disorder or condition to be treated, or a symptom associated therewith; (xi) inhibit or reduce the disease, disorder or condition to be treated, or a symptom associated therewith in a subject; and/or (xii) enhance or improve the prophylactic or therapeutic effect(s) of another therapy.

The therapeutically effective amount or dosage can vary according to various factors, such as the disease, disorder or condition to be treated, the means of administration, the target site, the physiological state of the subject (including, e.g., age, body weight, health), whether the subject is a human or an animal, other medications administered, and whether the treatment is prophylactic or therapeutic. Treatment dosages are optimally titrated to optimize safety and efficacy.

According to particular embodiments, the compositions described herein are formulated to be suitable for the intended route of administration to a subject. For example, the compositions described herein can be formulated to be suitable for intravenous, subcutaneous, or intramuscular administration.

As used herein, the terms "treat," "treating," and "treatment" are all intended to refer to an amelioration or reversal of at least one measurable physical parameter related to a cancer, which is not necessarily discernible in the subject, but can be discernible in the subject. The terms "treat," "treating," and "treatment," can also refer to causing regression, preventing the progression, or at least slowing down the progression of the disease, disorder, or condition. In a particular embodiment, "treat," "treating," and "treatment" refer to an alleviation, prevention of the development or onset, or reduction in the duration of one or more symptoms associated with the disease, disorder, or condition, such as a tumor or more preferably a cancer. In a particular embodiment, "treat," "treating," and "treatment" refer to prevention of the recurrence of the disease, disorder, or condition. In a particular embodiment, "treat," "treating," and "treatment" refer to an increase in the survival of a subject having the disease, disorder, or condition. In a particular embodiment, "treat," "treating," and "treatment" refer to elimination of the disease, disorder, or condition in the subject.

According to particular embodiments, provided are compositions used in the treatment of a cancer. For cancer therapy, the compositions can be used in combination with another treatment including, but not limited to, a chemotherapy, an anti-CD20 mAb, an anti-TIM-3 mAb, an anti-CTLA-4 antibody, an anti-PD-L1 antibody, an anti-PD-1 antibody, a PD-1/PD-L1 therapy, other immuno-oncology drugs, an antiangiogenic agent, a radiation therapy, an antibody-drug conjugate (ADC), a targeted therapy, or other anticancer drugs.

As used herein, the term "in combination," in the context of the administration of two or more therapies to a subject, refers to the use of more than one therapy. The use of the term "in combination" does not restrict the order in which therapies are administered to a subject. For example, a first therapy (e.g., a composition described herein) can be administered prior to (e.g., 5 minutes, 15 minutes, 30 minutes, 45 minutes, 1 hour, 2 hours, 4 hours, 6 hours, 12 hours, 16 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 16 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second therapy to a subject.

EMBODIMENTS

This invention provides the following non-limiting embodiments.

Embodiment 1 is an isolated monoclonal antibody or antigen-binding fragment thereof that specifically binds the C2 domain of CD33.

Embodiment 2 is the isolated monoclonal antibody or antigen-binding fragment thereof of embodiment 1, wherein the isolated monoclonal antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
  a. SEQ ID NOs:447, 448, 449, 567, 568, and 569, respectively;
  b. SEQ ID NOs:444, 445, 446, 564, 565, and 566, respectively;
  c. SEQ ID NOs:354, 355, 356, 477, 478, and 479, respectively;
  d. SEQ ID NOs:378, 379, 380, 501, 502, and 503, respectively;
  e. SEQ ID NOs:411, 412, 413, 531, 532, and 533, respectively;
  f. SEQ ID NOs:348, 349, 350, 471, 472, and 473, respectively;
  g. SEQ ID NOs:360, 361, 362, 483, 484, and 485, respectively;
  h. SEQ ID NOs:363, 364, 365, 486, 487, and 488, respectively;
  i. SEQ ID NOs:366, 367, 368, 489, 490, and 491, respectively;
  j. SEQ ID NOs:369, 370, 371, 492, 493, and 494, respectively;
  k. SEQ ID NOs:387, 388, 389, 492, 493, and 494, respectively;
  l. SEQ ID NOs:402, 403, 404, 522, 523, and 524, respectively;
  m. SEQ ID NOs:408, 409, 410, 528, 529, and 530, respectively;
  n. SEQ ID NOs:423, 424, 425, 543, 544, and 545, respectively; or
  o. SEQ ID NOs:426, 427, 428, 546, 547, and 548, respectively;
wherein the antibody or antigen-binding fragment thereof specifically binds CD33, preferably human CD33.

Embodiment 3 is the isolated monoclonal antibody or antigen-binding fragment thereof of embodiment 1 or 2, comprising a heavy chain variable region having a polypeptide sequence at least 95% identical to SEQ ID NO:292, 291, 261, 269, 280, 259, 263, 264, 265, 266, 272, 277, 279, 284, or 285, or a light chain variable region having a polypeptide sequence at least 95% identical to SEQ ID NO:332, 331, 302, 310, 320, 300, 304, 305, 306, 307, 317, 319, 324, or 325.

Embodiment 4 is the isolated monoclonal antibody or antigen-binding fragment thereof of any one of embodiments 1-3, comprising:
  a. a heavy chain variable region having the polypeptide sequence of SEQ ID NO:292, and a light chain variable region having the polypeptide sequence of SEQ ID NO:332;
  b. a heavy chain variable region having the polypeptide sequence of SEQ ID NO:291, and a light chain variable region having the polypeptide sequence of SEQ ID NO:331;
  c. a heavy chain variable region having the polypeptide sequence of SEQ ID NO:261, and a light chain variable region having the polypeptide sequence of SEQ ID NO:302;
  d. a heavy chain variable region having the polypeptide sequence of SEQ ID NO:269, and a light chain variable region having the polypeptide sequence of SEQ ID NO:310;
  e. a heavy chain variable region having the polypeptide sequence of SEQ ID NO:280, and a light chain variable region having the polypeptide sequence of SEQ ID NO:322;
  f. a heavy chain variable region having the polypeptide sequence of SEQ ID NO:259, and a light chain variable region having the polypeptide sequence of SEQ ID NO:300;
  g. a heavy chain variable region having the polypeptide sequence of SEQ ID NO:263, and a light chain variable region having the polypeptide sequence of SEQ ID NO:304;
  h. a heavy chain variable region having the polypeptide sequence of SEQ ID NO:264, and a light chain variable region having the polypeptide sequence of SEQ ID NO:305;
  i. a heavy chain variable region having the polypeptide sequence of SEQ ID NO:265, and a light chain variable region having the polypeptide sequence of SEQ ID NO:306;
  j. a heavy chain variable region having the polypeptide sequence of SEQ ID NO:266, and a light chain variable region having the polypeptide sequence of SEQ ID NO:307;
  k. a heavy chain variable region having the polypeptide sequence of SEQ ID NO:272, and a light chain variable region having the polypeptide sequence of SEQ ID NO:307;
  I. a heavy chain variable region having the polypeptide sequence of SEQ ID NO:277, and a light chain variable region having the polypeptide sequence of SEQ ID NO:317;
  m. a heavy chain variable region having the polypeptide sequence of SEQ ID NO:279, and a light chain variable region having the polypeptide sequence of SEQ ID NO:319;
  n. a heavy chain variable region having the polypeptide sequence of SEQ ID NO:284, and a light chain variable region having the polypeptide sequence of SEQ ID NO:324; or o. a heavy chain variable region having the polypeptide sequence of SEQ ID NO:285, and a light chain variable region having the polypeptide sequence of SEQ ID NO:325.

Embodiment 5 is an isolated monoclonal antibody or antigen-binding fragment thereof comprising a heavy chain complementarity determining region 1 (HCDR1), a HCDR2, a HCDR3, a light chain complementarity determining region 1 (LCDR1), a LCDR2, and a LCDR3, having the polypeptide sequences of a. SEQ ID NOs:357, 358, 359, 480, 481, and 482, respectively;
- b. SEQ ID NOs:372, 373, 374, 495, 496, and 497, respectively;
- c. SEQ ID NOs:375, 376, 377, 498, 499, and 500, respectively;
- d. SEQ ID NOs:381, 382, 383, 504, 505, and 506, respectively;
- e. SEQ ID NOs:384, 385, 386, 507, 508, and 509, respectively;
- f. SEQ ID NOs:390, 391, 392, 510, 511, and 512, respectively;
- g. SEQ ID NOs:393, 394, 395, 513, 514, and 515, respectively;
- h. SEQ ID NOs:396, 397, 398, 516, 517, and 518, respectively;
- i. SEQ ID NOs:399, 400, 401, 519, 520, and 521, respectively;
- j. SEQ ID NOs:405, 406, 407, 525, 526, and 527, respectively;
- k. SEQ ID NOs:414, 415, 416, 534, 535, and 536, respectively;
- l. SEQ ID NOs:417, 418, 419, 537, 538, and 539, respectively;
- m. SEQ ID NOs:420, 421, 422, 540, 541, and 542, respectively;
- n. SEQ ID NOs:429, 430, 431, 549, 550, and 551, respectively;
- o. SEQ ID NOs:432, 433, 434, 552, 553, and 554, respectively;
- p. SEQ ID NOs:435, 436, 437, 555, 556, and 557, respectively;
- q. SEQ ID NOs:438, 439, 440, 558, 559, and 560, respectively;
- r. SEQ ID NOs:441, 442, 443, 561, 562, and 563, respectively;
- s. SEQ ID NOs:450, 451, 452, 570, 571, and 572, respectively;
- t. SEQ ID NOs:453, 454, 455, 573, 574, and 575, respectively;
- u. SEQ ID NOs:456, 457, 458, 576, 577, and 578, respectively;
- v. SEQ ID NOs:459, 460, 461, 579, 580, and 581, respectively;
- w. SEQ ID NOs:378, 379, 380, 582, 583, and 584, respectively;
- x. SEQ ID NOs:414, 415, 416, 585, 586, and 587, respectively; or
- y. SEQ ID NOs:429, 430, 431, 480, 481, and 482, respectively;

wherein the antibody or antigen-binding fragment thereof specifically binds CD33, preferably human CD33.

Embodiment 6 is the isolated monoclonal antibody or antigen-binding fragment thereof of embodiment 5, comprising a heavy chain variable region having a polypeptide sequence at least 95% identical to one of SEQ ID NOs:260, 262, 267, 268, 270, 271, 273, 274, 275, 276, 278, 281, 282, 283, 286, 287, 288, 289, 290, 293, 294, 295, or 296, or a light chain variable region having a polypeptide sequence at least 95% identical to one of SEQ ID NOs:301, 303, 308, 309, 311, 312, 313, 314, 315, 316, 318, 321, 322, 323, 326, 327, 328, 329, 330, 333, 334, 335, 336, 337, or 338.

Embodiment 7 is the isolated monoclonal antibody or antigen-binding fragment thereof of embodiment 5 or 6, comprising:
- a. a heavy chain variable region having the polypeptide sequence of SEQ ID NO:260, and a light chain variable region having the polypeptide sequence of SEQ ID NO:301;
- b. a heavy chain variable region having the polypeptide sequence of SEQ ID NO:262, and a light chain variable region having the polypeptide sequence of SEQ ID NO:303;
- c. a heavy chain variable region having the polypeptide sequence of SEQ ID NO:267, and a light chain variable region having the polypeptide sequence of SEQ ID NO:308;
- d. a heavy chain variable region having the polypeptide sequence of SEQ ID NO:268, and a light chain variable region having the polypeptide sequence of SEQ ID NO:309;
- e. a heavy chain variable region having the polypeptide sequence of SEQ ID NO:270, and a light chain variable region having the polypeptide sequence of SEQ ID NO:311;
- f. a heavy chain variable region having the polypeptide sequence of SEQ ID NO:271, and a light chain variable region having the polypeptide sequence of SEQ ID NO:312;
- g. a heavy chain variable region having the polypeptide sequence of SEQ ID NO:273, and a light chain variable region having the polypeptide sequence of SEQ ID NO:313;
- h. a heavy chain variable region having the polypeptide sequence of SEQ ID NO:274, and a light chain variable region having the polypeptide sequence of SEQ ID NO:314;
- i. a heavy chain variable region having the polypeptide sequence of SEQ ID NO:275, and a light chain variable region having the polypeptide sequence of SEQ ID NO:315;
- j. a heavy chain variable region having the polypeptide sequence of SEQ ID NO:276, and a light chain variable region having the polypeptide sequence of SEQ ID NO:316;
- k. a heavy chain variable region having the polypeptide sequence of SEQ ID NO:278, and a light chain variable region having the polypeptide sequence of SEQ ID NO:318;
- l. a heavy chain variable region having the polypeptide sequence of SEQ ID NO:281, and a light chain variable region having the polypeptide sequence of SEQ ID NO:321;
- m. a heavy chain variable region having the polypeptide sequence of SEQ ID NO:282, and a light chain variable region having the polypeptide sequence of SEQ ID NO:322;
- n. a heavy chain variable region having the polypeptide sequence of SEQ ID NO:283, and a light chain variable region having the polypeptide sequence of SEQ ID NO:323;
- o. a heavy chain variable region having the polypeptide sequence of SEQ ID NO:286, and a light chain variable region having the polypeptide sequence of SEQ ID NO:326;

p. a heavy chain variable region having the polypeptide sequence of SEQ ID NO:287, and a light chain variable region having the polypeptide sequence of SEQ ID NO:327;
q. a heavy chain variable region having the polypeptide sequence of SEQ ID NO:288, and a light chain variable region having the polypeptide sequence of SEQ ID NO:328;
r. a heavy chain variable region having the polypeptide sequence of SEQ ID NO:289, and a light chain variable region having the polypeptide sequence of SEQ ID NO:329;
s. a heavy chain variable region having the polypeptide sequence of SEQ ID NO:290, and a light chain variable region having the polypeptide sequence of SEQ ID NO:330;
t. a heavy chain variable region having the polypeptide sequence of SEQ ID NO:293, and a light chain variable region having the polypeptide sequence of SEQ ID NO:333;
u. a heavy chain variable region having the polypeptide sequence of SEQ ID NO:294, and a light chain variable region having the polypeptide sequence of SEQ ID NO:334;
v. a heavy chain variable region having the polypeptide sequence of SEQ ID NO:295, and a light chain variable region having the polypeptide sequence of SEQ ID NO:335;
w. a heavy chain variable region having the polypeptide sequence of SEQ ID NO:296, and a light chain variable region having the polypeptide sequence of SEQ ID NO:336;
x. a heavy chain variable region having the polypeptide sequence of SEQ ID NO:269, and a light chain variable region having the polypeptide sequence of SEQ ID NO:337;
y. a heavy chain variable region having the polypeptide sequence of SEQ ID NO:281, and a light chain variable region having the polypeptide sequence of SEQ ID NO:338; or
z. a heavy chain variable region having the polypeptide sequence of SEQ ID NO:286, and a light chain variable region having the polypeptide sequence of SEQ ID NO:303.

Embodiment 8 is the isolated monoclonal antibody or antigen-binding fragment thereof of any one of embodiments 1-4, wherein the monoclonal antibody or antigen-binding fragment thereof induces antibody-dependent cell-mediated cytotoxicity (ADCC) in vitro with an $EC_{50}$ of less than about 2 nM.

Embodiment 9 is the isolated monoclonal antibody or antigen-binding fragment thereof of embodiment 8, wherein the monoclonal antibody or antigen-binding fragment thereof comprises an IgG1 low fucose backbone.

Embodiment 10 is the isolated monoclonal antibody or antigen-binding fragment thereof of any one of embodiments 1-7, wherein the monoclonal antibody or antigen-binding fragment thereof binds CD33 with a dissociation constant (KD) of less than about $5 \times 10^{-9}$ M.

Embodiment 11 is the isolated monoclonal antibody or antigen-binding fragment thereof of any one of embodiments 1-7, wherein the monoclonal antibody or antigen-binding fragment thereof binds CD33 and induces internalization with an $EC_{50}$ of less than about 2 nM.

Embodiment 12 is the isolated monoclonal antibody or antigen-binding fragment thereof of any one of embodiments 1-11, wherein the monoclonal antibody or antigen-binding fragment thereof inhibits CD33 activity.

Embodiment 13 is the isolated monoclonal antibody or antigen-binding fragment thereof of any one of embodiments 1-12, wherein the antibody or antigen-binding fragment thereof is chimeric.

Embodiment 14 is the isolated monoclonal antibody or antigen-binding fragment thereof of any one of embodiments 1-13, wherein the antibody or antigen-binding fragment thereof is human or humanized.

Embodiment 15 is the isolated monoclonal antibody or antigen-binding fragment thereof of any one of embodiments 1-13, wherein the antibody or antigen-binding fragment thereof is conjugated to a therapeutic agent.

Embodiment 16 is an isolated nucleic acid encoding the monoclonal antibody or antigen-binding fragment thereof of any one of embodiments 1-14.

Embodiment 17 is a vector comprising the isolated nucleic acid of embodiment 16.

Embodiment 18 is a host cell comprising the vector of embodiment 17.

Embodiment 19 is a pharmaceutical composition, comprising the isolated monoclonal antibody or antigen-binding fragment thereof of any one of embodiments 1-14 and a pharmaceutically acceptable carrier.

Embodiment 20 is a method of treating cancer in a subject in need thereof, comprising administering to the subject the pharmaceutical composition of embodiment 19.

Embodiment 21 is the method of embodiment 20, wherein the cancer is a hematologic cancer.

Embodiment 22 is the method of embodiment 21, wherein the hematologic cancer is selected from the group consisting of a leukemia, a lymphoma, or a multiple myeloma.

Embodiment 23 is the method of embodiment 22, wherein the hematologic cancer is acute myeloid leukemia (AML), myelodysplastic syndrome (MDS), acute lymphocytic leukemia (ALL), diffuse large B-cell lymphoma (DLBCL), chronic myeloid leukemia (CML) or blastic plasmacytoid dendritic cell neoplasm (DPDCN).

Embodiment 24 is a method of producing the monoclonal antibody or antigen-binding fragment thereof of any one of embodiments 1-14, comprising culturing a cell comprising a nucleic acid encoding the monoclonal antibody or antigen-binding fragment under conditions to produce the monoclonal antibody or antigen-binding fragment, and recovering the antibody or antigen-binding fragment from the cell or culture.

Embodiment 25 is a method of producing a pharmaceutical composition comprising the monoclonal antibody or antigen-binding fragment of any one of embodiments 1-14, comprising combining the monoclonal antibody or antigen-binding fragment thereof with a pharmaceutically acceptable carrier to obtain the pharmaceutical composition.

Embodiment 26 is an anti-CD33/anti-CD3 bispecific antibody comprising an anti-CD33 antibody or an antigen-binding fragment thereof and an anti-CD3 antibody or antigen-binding fragment thereof,
wherein the anti-CD33 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
a. SEQ ID NOs:447, 448, 449, 567, 568, and 569, respectively;
b. SEQ ID NOs:444, 445, 446, 564, 565, and 566, respectively;

c. SEQ ID NOs:354, 355, 356, 477, 478, and 479, respectively;
d. SEQ ID NOs:378, 379, 380, 501, 502, and 503, respectively;
e. SEQ ID NOs:411, 412, 413, 531, 532, and 533, respectively;
f. SEQ ID NOs:348, 349, 350, 471, 472, and 473, respectively;
g. SEQ ID NOs:360, 361, 362, 483, 484, and 485, respectively;
h. SEQ ID NOs:363, 364, 365, 486, 487, and 488, respectively;
i. SEQ ID NOs:366, 367, 368, 489, 490, and 491, respectively;
j. SEQ ID NOs:369, 370, 371, 492, 493, and 494, respectively;
k. SEQ ID NOs:387, 388, 389, 492, 493, and 494, respectively;
l. SEQ ID NOs:402, 403, 404, 522, 523, and 524, respectively;
m. SEQ ID NOs:408, 409, 410, 528, 529, and 530, respectively;
n. SEQ ID NOs:423, 424, 425, 543, 544, and 545, respectively; or
o. SEQ ID NOs:426, 427, 428, 546, 547, and 548, respectively;

and the anti-CD3 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
 1) SEQ ID NOs: 342, 343, 344, 465, 466, and 467, respectively; or
 2) SEQ ID NOs: 345, 346, 347, 468, 469, and 470, respectively.

Embodiment 27 is the anti-CD33/anti-CD3 bispecific antibody or antigen-binding fragment thereof of embodiment 25, wherein the anti-CD33 antibody or antigen-binding fragment thereof comprises a heavy chain variable region having a polypeptide sequence at least 95% identical to SEQ ID NO:292, 291, 261, 269, 280, 259, 263, 264, 265, 266, 272, 277, 279, 284, or 285, or a light chain variable region having a polypeptide sequence at least 95% identical to SEQ ID NO:332, 331, 302, 310, 320, 300, 304, 305, 306, 307, 317, 319, 324, or 325; and the anti-CD3 antibody or antigen-binding fragment thereof comprises a heavy chain variable region having a polypeptide sequence at least 95% identical to SEQ ID NO:257 or 258, or a light chain variable region having a polypeptide sequence at least 95% identical to SEQ ID NO:298 or 299.

Embodiment 28 is the anti-CD33/anti-CD3 bispecific antibody or antigen-binding fragment thereof of embodiment 25 or 26, comprising:
a. a heavy chain variable region having the polypeptide sequence of SEQ ID NO:292, and a light chain variable region having the polypeptide sequence of SEQ ID NO:332; and a heavy chain variable region having the polypeptide sequence of SEQ ID NO:257, and a light chain variable region having a polypeptide sequence of SEQ ID NO:298;
b. a heavy chain variable region having the polypeptide sequence of SEQ ID NO:291, and a light chain variable region having the polypeptide sequence of SEQ ID NO:331; and a heavy chain variable region having the polypeptide sequence of SEQ ID NO:257, and a light chain variable region having a polypeptide sequence of SEQ ID NO:298;
c. a heavy chain variable region having the polypeptide sequence of SEQ ID NO:261, and a light chain variable region having the polypeptide sequence of SEQ ID NO:302; and a heavy chain variable region having the polypeptide sequence of SEQ ID NO:257, and a light chain variable region having a polypeptide sequence of SEQ ID NO:298;
d. a heavy chain variable region having the polypeptide sequence of SEQ ID NO:269, and a light chain variable region having the polypeptide sequence of SEQ ID NO:310; and a heavy chain variable region having the polypeptide sequence of SEQ ID NO:257, and a light chain variable region having a polypeptide sequence of SEQ ID NO:298;
e. a heavy chain variable region having the polypeptide sequence of SEQ ID NO:280, and a light chain variable region having the polypeptide sequence of SEQ ID NO:322; and a heavy chain variable region having the polypeptide sequence of SEQ ID NO:257, and a light chain variable region having a polypeptide sequence of SEQ ID NO:298;
f. a heavy chain variable region having the polypeptide sequence of SEQ ID NO:259, and a light chain variable region having the polypeptide sequence of SEQ ID NO:300; and a heavy chain variable region having the polypeptide sequence of SEQ ID NO:257, and a light chain variable region having a polypeptide sequence of SEQ ID NO:298;
g. a heavy chain variable region having the polypeptide sequence of SEQ ID NO:263, and a light chain variable region having the polypeptide sequence of SEQ ID NO:304; and a heavy chain variable region having the polypeptide sequence of SEQ ID NO:257, and a light chain variable region having a polypeptide sequence of SEQ ID NO:298;
h. a heavy chain variable region having the polypeptide sequence of SEQ ID NO:264, and a light chain variable region having the polypeptide sequence of SEQ ID NO:305; and a heavy chain variable region having the polypeptide sequence of SEQ ID NO:257, and a light chain variable region having a polypeptide sequence of SEQ ID NO:298;
i. a heavy chain variable region having the polypeptide sequence of SEQ ID NO:265, and a light chain variable region having the polypeptide sequence of SEQ ID NO:306; and a heavy chain variable region having the polypeptide sequence of SEQ ID NO:257, and a light chain variable region having a polypeptide sequence of SEQ ID NO:298;
j. a heavy chain variable region having the polypeptide sequence of SEQ ID NO:266, and a light chain variable region having the polypeptide sequence of SEQ ID NO:307; and a heavy chain variable region having the polypeptide sequence of SEQ ID NO:257, and a light chain variable region having a polypeptide sequence of SEQ ID NO:298;
k. a heavy chain variable region having the polypeptide sequence of SEQ ID NO:272, and a light chain variable region having the polypeptide sequence of SEQ ID NO:307; and a heavy chain variable region having the polypeptide sequence of SEQ ID NO:257, and a light chain variable region having a polypeptide sequence of SEQ ID NO:298;
l. a heavy chain variable region having the polypeptide sequence of SEQ ID NO:277, and a light chain variable region having the polypeptide sequence of SEQ ID NO:317; and a heavy chain variable region having the polypeptide sequence of SEQ ID NO:257, and a light chain variable region having a polypeptide sequence of SEQ ID NO:298;
m. a heavy chain variable region having the polypeptide sequence of SEQ ID NO:279, and a light chain variable region having the polypeptide sequence of SEQ ID NO:319; and a heavy chain variable region having the polypeptide sequence of SEQ ID NO:257, and a light chain variable region having a polypeptide sequence of SEQ ID NO:298;
n. a heavy chain variable region having the polypeptide sequence of SEQ ID NO:284, and a light chain variable region having the polypeptide sequence of SEQ ID NO:324; and a heavy chain variable region having the polypeptide sequence of SEQ ID NO:257, and a light chain variable region having a polypeptide sequence of SEQ ID NO:298;
o. a heavy chain variable region having the polypeptide sequence of SEQ ID NO:285, and a light chain variable region having the polypeptide sequence of SEQ ID NO:325; and a heavy chain variable region having the polypeptide sequence of SEQ ID NO:257, and a light chain variable region having a polypeptide sequence of SEQ ID NO:298;
p. a heavy chain variable region having the polypeptide sequence of SEQ ID NO:292, and a light chain variable region having the polypeptide sequence of SEQ ID NO:332; and a heavy chain variable region having the polypeptide sequence of SEQ ID NO:258, and a light chain variable region having a polypeptide sequence of SEQ ID NO:299;
q. a heavy chain variable region having the polypeptide sequence of SEQ ID NO:291, and a light chain variable region having the polypeptide sequence of SEQ ID NO:331; and a heavy chain variable region having the polypeptide sequence of SEQ ID NO:258, and a light chain variable region having a polypeptide sequence of SEQ ID NO:299;
r. a heavy chain variable region having the polypeptide sequence of SEQ ID NO:261, and a light chain variable region having the polypeptide sequence of SEQ ID NO:302; and a heavy chain variable region having the polypeptide sequence of SEQ ID NO:258, and a light chain variable region having a polypeptide sequence of SEQ ID NO:299;
s. a heavy chain variable region having the polypeptide sequence of SEQ ID NO:269, and a light chain variable region having the polypeptide sequence of SEQ ID NO:310; and a heavy chain variable region having the polypeptide sequence of SEQ ID NO:258, and a light chain variable region having a polypeptide sequence of SEQ ID NO:299;
t. a heavy chain variable region having the polypeptide sequence of SEQ ID NO:280, and a light chain variable region having the polypeptide sequence of SEQ ID NO:322; and a heavy chain variable region having the polypeptide sequence of SEQ ID NO:258, and a light chain variable region having a polypeptide sequence of SEQ ID NO:299;
u. a heavy chain variable region having the polypeptide sequence of SEQ ID NO:259, and a light chain variable region having the polypeptide sequence of SEQ ID NO:300; and a heavy chain variable region having the polypeptide sequence of SEQ ID NO:258, and a light chain variable region having a polypeptide sequence of SEQ ID NO:299;
v. a heavy chain variable region having the polypeptide sequence of SEQ ID NO:263, and a light chain variable region having the polypeptide sequence of SEQ ID NO:304; and a heavy chain variable region having the polypeptide sequence of SEQ ID NO:258, and a light chain variable region having a polypeptide sequence of SEQ ID NO:299;
w. a heavy chain variable region having the polypeptide sequence of SEQ ID NO:264, and a light chain variable region having the polypeptide sequence of SEQ ID NO:305; and a heavy chain variable region having the polypeptide sequence of SEQ ID NO:258, and a light chain variable region having a polypeptide sequence of SEQ ID NO:299;
x. a heavy chain variable region having the polypeptide sequence of SEQ ID NO:265, and a light chain variable region having the polypeptide sequence of SEQ ID NO:306; and a heavy chain variable region having the polypeptide sequence of SEQ ID NO:258, and a light chain variable region having a polypeptide sequence of SEQ ID NO:299;
y. a heavy chain variable region having the polypeptide sequence of SEQ ID NO:266, and a light chain variable region having the polypeptide sequence of SEQ ID NO:307; and a heavy chain variable region having the polypeptide sequence of SEQ ID NO:258, and a light chain variable region having a polypeptide sequence of SEQ ID NO:299;
z. a heavy chain variable region having the polypeptide sequence of SEQ ID NO:272, and a light chain variable region having the polypeptide sequence of SEQ ID NO:307; and a heavy chain variable region having the polypeptide sequence of SEQ ID NO:258, and a light chain variable region having a polypeptide sequence of SEQ ID NO:299;
aa. a heavy chain variable region having the polypeptide sequence of SEQ ID NO:277, and a light chain variable region having the polypeptide sequence of SEQ ID NO:317; and a heavy chain variable region having the polypeptide sequence of SEQ ID NO:258, and a light chain variable region having a polypeptide sequence of SEQ ID NO:299;
bb. a heavy chain variable region having the polypeptide sequence of SEQ ID NO:279, and a light chain variable region having the polypeptide sequence of SEQ ID NO:319; and a heavy chain variable region having the polypeptide sequence of SEQ ID NO:258, and a light chain variable region having a polypeptide sequence of SEQ ID NO:299;
cc. a heavy chain variable region having the polypeptide sequence of SEQ ID NO:284, and a light chain variable region having the polypeptide sequence of SEQ ID NO:324; and a heavy chain variable region having the polypeptide sequence of SEQ ID NO:258, and a light chain variable region having a polypeptide sequence of SEQ ID NO:299; or
dd. a heavy chain variable region having the polypeptide sequence of SEQ ID NO:285, and a light chain variable region having the polypeptide sequence of SEQ ID NO:325; and a heavy chain variable region having the polypeptide sequence of SEQ ID NO:258, and a light chain variable region having a polypeptide sequence of SEQ ID NO:299.

Embodiment 29 is the anti-CD33/anti-CD3 bispecific antibody or antigen-binding fragment thereof of any one of embodiments 26-28, wherein the anti-CD33 antibody or antigen-binding fragment thereof specifically binds the C2 domain of CD33.

Embodiment 30 is an anti-CD33/anti-CD3 bispecific antibody comprising an anti-CD33 antibody or an antigen-binding fragment thereof and an anti-CD3 antibody or antigen-binding fragment thereof,
wherein the anti-CD33 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
 a. SEQ ID NOs:357, 358, 359, 480, 481, and 482, respectively;
 b. SEQ ID NOs:372, 373, 374, 495, 496, and 497, respectively;
 c. SEQ ID NOs:375, 376, 377, 498, 499, and 500, respectively;
 d. SEQ ID NOs:381, 382, 383, 504, 505, and 506, respectively;
 e. SEQ ID NOs:384, 385, 386, 507, 508, and 509, respectively;
 f. SEQ ID NOs:390, 391, 392, 510, 511, and 512, respectively;
 g. SEQ ID NOs:393, 394, 395, 513, 514, and 515, respectively;
 h. SEQ ID NOs:396, 397, 398, 516, 517, and 518, respectively;
 i. SEQ ID NOs:399, 400, 401, 519, 520, and 521, respectively;
 j. SEQ ID NOs:405, 406, 407, 525, 526, and 527, respectively;
 k. SEQ ID NOs:414, 415, 416, 534, 535, and 536, respectively;
 l. SEQ ID NOs:417, 418, 419, 537, 538, and 539, respectively;
 m. SEQ ID NOs:420, 421, 422, 540, 541, and 542, respectively;
 n. SEQ ID NOs:429, 430, 431, 549, 550, and 551, respectively;
 o. SEQ ID NOs:432, 433, 434, 552, 553, and 554, respectively;
 p. SEQ ID NOs:435, 436, 437, 555, 556, and 557, respectively;
 q. SEQ ID NOs:438, 439, 440, 558, 559, and 560, respectively;
 r. SEQ ID NOs:441, 442, 443, 561, 562, and 563, respectively;
 s. SEQ ID NOs:450, 451, 452, 570, 571, and 572, respectively;
 t. SEQ ID NOs:453, 454, 455, 573, 574, and 575, respectively;
 u. SEQ ID NOs:456, 457, 458, 576, 577, and 578, respectively;
 v. SEQ ID NOs:459, 460, 461, 579, 580, and 581, respectively;
 w. SEQ ID NOs:378, 379, 380, 582, 583, and 584, respectively;
 x. SEQ ID NOs:414, 415, 416, 585, 586, and 587, respectively; or
 y. SEQ ID NOs:429, 430, 431, 480, 481, and 482, respectively;
and the anti-CD3 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
 1) SEQ ID NOs: 342, 343, 344, 465, 466, and 467, respectively; or
 2) SEQ ID NOs: 345, 346, 347, 468, 469, and 470, respectively.

Embodiment 31 is the anti-CD33/anti-CD3 bispecific antibody or antigen-binding fragment thereof of embodiment 29, wherein the anti-CD33 antibody or antigen-binding fragment thereof comprises a heavy chain variable region having a polypeptide sequence at least 95% identical to one of SEQ ID NOs:260, 262, 267, 268, 270, 271, 273, 274, 275, 276, 278, 281, 282, 283, 286, 287, 288, 289, 290, 293, 294, 295, or 296, or a light chain variable region having a polypeptide sequence at least 95% identical to one of SEQ ID NOs:301, 303, 308, 309, 311, 312, 313, 314, 315, 316, 318, 321, 322, 323, 326, 327, 328, 329, 330, 333, 334, 335, 336, 337, or 338; and the anti-CD3 antibody or antigen-binding fragment thereof comprises a heavy chain variable region having a polypeptide sequence at least 95% identical to SEQ ID NO:257 or 258, or a light chain variable region having a polypeptide sequence at least 95% identical to SEQ ID NO:298 or 299.

Embodiment 32 is the anti-CD33/anti-CD3 bispecific antibody or antigen-binding fragment thereof of embodiment 29 or 30, comprising:
 a. a heavy chain variable region having the polypeptide sequence of SEQ ID NO:260, and a light chain variable region having the polypeptide sequence of SEQ ID NO:301; and a heavy chain variable region having the polypeptide sequence of SEQ ID NO:257, and a light chain variable region having a polypeptide sequence of SEQ ID NO:298;
 b. a heavy chain variable region having the polypeptide sequence of SEQ ID NO:262, and a light chain variable region having the polypeptide sequence of SEQ ID NO:303; and a heavy chain variable region having the polypeptide sequence of SEQ ID NO:257, and a light chain variable region having a polypeptide sequence of SEQ ID NO:298;
 c. a heavy chain variable region having the polypeptide sequence of SEQ ID NO:267, and a light chain variable region having the polypeptide sequence of SEQ ID NO:308; and a heavy chain variable region having the polypeptide sequence of SEQ ID NO:257, and a light chain variable region having a polypeptide sequence of SEQ ID NO:298;
 d. a heavy chain variable region having the polypeptide sequence of SEQ ID NO:268, and a light chain variable region having the polypeptide sequence of SEQ ID NO:309; and a heavy chain variable region having the polypeptide sequence of SEQ ID NO:257, and a light chain variable region having a polypeptide sequence of SEQ ID NO:298;
 e. a heavy chain variable region having the polypeptide sequence of SEQ ID NO:270, and a light chain variable region having the polypeptide sequence of SEQ ID NO:311; and a heavy chain variable region having the polypeptide sequence of SEQ ID NO:257, and a light chain variable region having a polypeptide sequence of SEQ ID NO:298;
 f. a heavy chain variable region having the polypeptide sequence of SEQ ID NO:271, and a light chain variable region having the polypeptide sequence of SEQ ID NO:312; and a heavy chain variable region having the polypeptide sequence of SEQ ID NO:257, and a light chain variable region having a polypeptide sequence of SEQ ID NO:298;

g. a heavy chain variable region having the polypeptide sequence of SEQ ID NO:273, and a light chain variable region having the polypeptide sequence of SEQ ID NO:313; and a heavy chain variable region having the polypeptide sequence of SEQ ID NO:257, and a light chain variable region having a polypeptide sequence of SEQ ID NO:298;
h. a heavy chain variable region having the polypeptide sequence of SEQ ID NO:274, and a light chain variable region having the polypeptide sequence of SEQ ID NO:314; and a heavy chain variable region having the polypeptide sequence of SEQ ID NO:257, and a light chain variable region having a polypeptide sequence of SEQ ID NO:298;
i. a heavy chain variable region having the polypeptide sequence of SEQ ID NO:275, and a light chain variable region having the polypeptide sequence of SEQ ID NO:315; and a heavy chain variable region having the polypeptide sequence of SEQ ID NO:257, and a light chain variable region having a polypeptide sequence of SEQ ID NO:298;
j. a heavy chain variable region having the polypeptide sequence of SEQ ID NO:276, and a light chain variable region having the polypeptide sequence of SEQ ID NO:316; and a heavy chain variable region having the polypeptide sequence of SEQ ID NO:257, and a light chain variable region having a polypeptide sequence of SEQ ID NO:298;
k. a heavy chain variable region having the polypeptide sequence of SEQ ID NO:278, and a light chain variable region having the polypeptide sequence of SEQ ID NO:318; and a heavy chain variable region having the polypeptide sequence of SEQ ID NO:257, and a light chain variable region having a polypeptide sequence of SEQ ID NO:298;
l. a heavy chain variable region having the polypeptide sequence of SEQ ID NO:281, and a light chain variable region having the polypeptide sequence of SEQ ID NO:321; and a heavy chain variable region having the polypeptide sequence of SEQ ID NO:257, and a light chain variable region having a polypeptide sequence of SEQ ID NO:298;
m. a heavy chain variable region having the polypeptide sequence of SEQ ID NO:282, and a light chain variable region having the polypeptide sequence of SEQ ID NO:322; and a heavy chain variable region having the polypeptide sequence of SEQ ID NO:257, and a light chain variable region having a polypeptide sequence of SEQ ID NO:298;
n. a heavy chain variable region having the polypeptide sequence of SEQ ID NO:283, and a light chain variable region having the polypeptide sequence of SEQ ID NO:323; and a heavy chain variable region having the polypeptide sequence of SEQ ID NO:257, and a light chain variable region having a polypeptide sequence of SEQ ID NO:298;
o. a heavy chain variable region having the polypeptide sequence of SEQ ID NO:286, and a light chain variable region having the polypeptide sequence of SEQ ID NO:326; and a heavy chain variable region having the polypeptide sequence of SEQ ID NO:257, and a light chain variable region having a polypeptide sequence of SEQ ID NO:298;
p. a heavy chain variable region having the polypeptide sequence of SEQ ID NO:287, and a light chain variable region having the polypeptide sequence of SEQ ID NO:327; and a heavy chain variable region having the polypeptide sequence of SEQ ID NO:257, and a light chain variable region having a polypeptide sequence of SEQ ID NO:298;
q. a heavy chain variable region having the polypeptide sequence of SEQ ID NO:288, and a light chain variable region having the polypeptide sequence of SEQ ID NO:328; and a heavy chain variable region having the polypeptide sequence of SEQ ID NO:257, and a light chain variable region having a polypeptide sequence of SEQ ID NO:298;
r. a heavy chain variable region having the polypeptide sequence of SEQ ID NO:289, and a light chain variable region having the polypeptide sequence of SEQ ID NO:329; and a heavy chain variable region having the polypeptide sequence of SEQ ID NO:257, and a light chain variable region having a polypeptide sequence of SEQ ID NO:298;
s. a heavy chain variable region having the polypeptide sequence of SEQ ID NO:290, and a light chain variable region having the polypeptide sequence of SEQ ID NO:330; and a heavy chain variable region having the polypeptide sequence of SEQ ID NO:257, and a light chain variable region having a polypeptide sequence of SEQ ID NO:298;
t. a heavy chain variable region having the polypeptide sequence of SEQ ID NO:293, and a light chain variable region having the polypeptide sequence of SEQ ID NO:333; and a heavy chain variable region having the polypeptide sequence of SEQ ID NO:257, and a light chain variable region having a polypeptide sequence of SEQ ID NO:298;
u. a heavy chain variable region having the polypeptide sequence of SEQ ID NO:294, and a light chain variable region having the polypeptide sequence of SEQ ID NO:334; and a heavy chain variable region having the polypeptide sequence of SEQ ID NO:257, and a light chain variable region having a polypeptide sequence of SEQ ID NO:298;
v. a heavy chain variable region having the polypeptide sequence of SEQ ID NO:295, and a light chain variable region having the polypeptide sequence of SEQ ID NO:335; and a heavy chain variable region having the polypeptide sequence of SEQ ID NO:257, and a light chain variable region having a polypeptide sequence of SEQ ID NO:298;
w. a heavy chain variable region having the polypeptide sequence of SEQ ID NO:296, and a light chain variable region having the polypeptide sequence of SEQ ID NO:336; and a heavy chain variable region having the polypeptide sequence of SEQ ID NO:257, and a light chain variable region having a polypeptide sequence of SEQ ID NO:298;
x. a heavy chain variable region having the polypeptide sequence of SEQ ID NO:269, and a light chain variable region having the polypeptide sequence of SEQ ID NO:337; and a heavy chain variable region having the polypeptide sequence of SEQ ID NO:257, and a light chain variable region having a polypeptide sequence of SEQ ID NO:298;
y. a heavy chain variable region having the polypeptide sequence of SEQ ID NO:281, and a light chain variable region having the polypeptide sequence of SEQ ID NO:338; and a heavy chain variable region having the polypeptide sequence of SEQ ID NO:257, and a light chain variable region having a polypeptide sequence of SEQ ID NO:298;

z. a heavy chain variable region having the polypeptide sequence of SEQ ID NO:286, and a light chain variable region having the polypeptide sequence of SEQ ID NO:303; and a heavy chain variable region having the polypeptide sequence of SEQ ID NO:257, and a light chain variable region having a polypeptide sequence of SEQ ID NO:298;
aa. a heavy chain variable region having the polypeptide sequence of SEQ ID NO:260, and a light chain variable region having the polypeptide sequence of SEQ ID NO:301; and a heavy chain variable region having the polypeptide sequence of SEQ ID NO:258, and a light chain variable region having a polypeptide sequence of SEQ ID NO:299;
bb. a heavy chain variable region having the polypeptide sequence of SEQ ID NO:262, and a light chain variable region having the polypeptide sequence of SEQ ID NO:303; and a heavy chain variable region having the polypeptide sequence of SEQ ID NO:258, and a light chain variable region having a polypeptide sequence of SEQ ID NO:299;
cc. a heavy chain variable region having the polypeptide sequence of SEQ ID NO:267, and a light chain variable region having the polypeptide sequence of SEQ ID NO:308; and a heavy chain variable region having the polypeptide sequence of SEQ ID NO:258, and a light chain variable region having a polypeptide sequence of SEQ ID NO:299;
dd. a heavy chain variable region having the polypeptide sequence of SEQ ID NO:268, and a light chain variable region having the polypeptide sequence of SEQ ID NO:309; and a heavy chain variable region having the polypeptide sequence of SEQ ID NO:258, and a light chain variable region having a polypeptide sequence of SEQ ID NO:299;
ee. a heavy chain variable region having the polypeptide sequence of SEQ ID NO:270, and a light chain variable region having the polypeptide sequence of SEQ ID NO:311; and a heavy chain variable region having the polypeptide sequence of SEQ ID NO:258, and a light chain variable region having a polypeptide sequence of SEQ ID NO:299;
ff. a heavy chain variable region having the polypeptide sequence of SEQ ID NO:271, and a light chain variable region having the polypeptide sequence of SEQ ID NO:312; and a heavy chain variable region having the polypeptide sequence of SEQ ID NO:258, and a light chain variable region having a polypeptide sequence of SEQ ID NO:299,
gg. a heavy chain variable region having the polypeptide sequence of SEQ ID NO:273, and a light chain variable region having the polypeptide sequence of SEQ ID NO:313; and a heavy chain variable region having the polypeptide sequence of SEQ ID NO:258, and a light chain variable region having a polypeptide sequence of SEQ ID NO:299;
hh. a heavy chain variable region having the polypeptide sequence of SEQ ID NO:274, and a light chain variable region having the polypeptide sequence of SEQ ID NO:314; and a heavy chain variable region having the polypeptide sequence of SEQ ID NO:258, and a light chain variable region having a polypeptide sequence of SEQ ID NO:299;
ii. a heavy chain variable region having the polypeptide sequence of SEQ ID NO:275, and a light chain variable region having the polypeptide sequence of SEQ ID NO:315; and a heavy chain variable region having the polypeptide sequence of SEQ ID NO:258, and a light chain variable region having a polypeptide sequence of SEQ ID NO:299;
jj. a heavy chain variable region having the polypeptide sequence of SEQ ID NO:276, and a light chain variable region having the polypeptide sequence of SEQ ID NO:316; and a heavy chain variable region having the polypeptide sequence of SEQ ID NO:258, and a light chain variable region having a polypeptide sequence of SEQ ID NO:299;
kk. a heavy chain variable region having the polypeptide sequence of SEQ ID NO:278, and a light chain variable region having the polypeptide sequence of SEQ ID NO:318; and a heavy chain variable region having the polypeptide sequence of SEQ ID NO:258, and a light chain variable region having a polypeptide sequence of SEQ ID NO:299;
ll. a heavy chain variable region having the polypeptide sequence of SEQ ID NO:281, and a light chain variable region having the polypeptide sequence of SEQ ID NO:321; and a heavy chain variable region having the polypeptide sequence of SEQ ID NO:258, and a light chain variable region having a polypeptide sequence of SEQ ID NO:299,
mm. a heavy chain variable region having the polypeptide sequence of SEQ ID NO:282, and a light chain variable region having the polypeptide sequence of SEQ ID NO:322; and a heavy chain variable region having the polypeptide sequence of SEQ ID NO:258, and a light chain variable region having a polypeptide sequence of SEQ ID NO:299;
nn. a heavy chain variable region having the polypeptide sequence of SEQ ID NO:283, and a light chain variable region having the polypeptide sequence of SEQ ID NO:323; and a heavy chain variable region having the polypeptide sequence of SEQ ID NO:258, and a light chain variable region having a polypeptide sequence of SEQ ID NO:299;
oo. a heavy chain variable region having the polypeptide sequence of SEQ ID NO:286, and a light chain variable region having the polypeptide sequence of SEQ ID NO:326; and a heavy chain variable region having the polypeptide sequence of SEQ ID NO:258, and a light chain variable region having a polypeptide sequence of SEQ ID NO:299;
pp. a heavy chain variable region having the polypeptide sequence of SEQ ID NO:287, and a light chain variable region having the polypeptide sequence of SEQ ID NO:327; and a heavy chain variable region having the polypeptide sequence of SEQ ID NO:258, and a light chain variable region having a polypeptide sequence of SEQ ID NO:299;
qq. a heavy chain variable region having the polypeptide sequence of SEQ ID NO:288, and a light chain variable region having the polypeptide sequence of SEQ ID NO:328; and a heavy chain variable region having the polypeptide sequence of SEQ ID NO:258, and a light chain variable region having a polypeptide sequence of SEQ ID NO:299;
rr. a heavy chain variable region having the polypeptide sequence of SEQ ID NO:289, and a light chain variable region having the polypeptide sequence of SEQ ID NO:329; and a heavy chain variable region having the polypeptide sequence of SEQ ID NO:258, and a light chain variable region having a polypeptide sequence of SEQ ID NO:299, ss. a heavy chain variable region having the polypeptide sequence of SEQ ID NO:290, and a light chain variable region having the polypeptide sequence of SEQ ID NO:330; and a heavy chain variable region having the polypeptide sequence of SEQ ID NO:258, and a light chain variable region having a polypeptide sequence of SEQ ID NO:299;

tt. a heavy chain variable region having the polypeptide sequence of SEQ ID NO:293, and a light chain variable region having the polypeptide sequence of SEQ ID NO:333; and a heavy chain variable region having the polypeptide sequence of SEQ ID NO:258, and a light chain variable region having a polypeptide sequence of SEQ ID NO:299;

uu. a heavy chain variable region having the polypeptide sequence of SEQ ID NO:294, and a light chain variable region having the polypeptide sequence of SEQ ID NO:334; and a heavy chain variable region having the polypeptide sequence of SEQ ID NO:258, and a light chain variable region having a polypeptide sequence of SEQ ID NO:299;

vv. a heavy chain variable region having the polypeptide sequence of SEQ ID NO:295, and a light chain variable region having the polypeptide sequence of SEQ ID NO:335; and a heavy chain variable region having the polypeptide sequence of SEQ ID NO:258, and a light chain variable region having a polypeptide sequence of SEQ ID NO:299;

ww. a heavy chain variable region having the polypeptide sequence of SEQ ID NO:296, and a light chain variable region having the polypeptide sequence of SEQ ID NO:336; and a heavy chain variable region having the polypeptide sequence of SEQ ID NO:258, and a light chain variable region having a polypeptide sequence of SEQ ID NO:299;

xx. a heavy chain variable region having the polypeptide sequence of SEQ ID NO:269, and a light chain variable region having the polypeptide sequence of SEQ ID NO:337; and a heavy chain variable region having the polypeptide sequence of SEQ ID NO:258, and a light chain variable region having a polypeptide sequence of SEQ ID NO:299, yy. a heavy chain variable region having the polypeptide sequence of SEQ ID NO:281, and a light chain variable region having the polypeptide sequence of SEQ ID NO:338; and a heavy chain variable region having the polypeptide sequence of SEQ ID NO:258, and a light chain variable region having a polypeptide sequence of SEQ ID NO:299; or zz. a heavy chain variable region having the polypeptide sequence of SEQ ID NO:286, and a light chain variable region having the polypeptide sequence of SEQ ID NO:303; and a heavy chain variable region having the polypeptide sequence of SEQ ID NO:258, and a light chain variable region having a polypeptide sequence of SEQ ID NO:299.

Embodiment 33 is the anti-CD33/anti-CD3 bispecific antibody or antigen-binding fragment thereof of any one of embodiments 26-32, wherein the anti-CD33/anti-CD3 bispecific antibody or antigen-binding fragment thereof induces T-cell dependent cytotoxicity in CD33-expressing cells in vitro with an $EC_{50}$ value of less than about 1 nM.

Embodiment 34 is the anti-CD33/anti-CD3 bispecific antibody or antigen-binding fragment thereof of any one of embodiments 26-33, wherein the bispecific antibody or antigen-binding fragment thereof is chimeric.

Embodiment 35 is the anti-CD33/anti-CD3 bispecific antibody or antigen-binding fragment thereof of any one of embodiments 26-34, wherein the bispecific antibody or antigen-binding fragment thereof is human or humanized.

Embodiment 36 is an isolated nucleic acid encoding the anti-CD33/anti-CD3 bispecific antibody or antigen-binding fragment thereof of any one of embodiments 26-35.

Embodiment 37 is a vector comprising the isolated nucleic acid of embodiment 36.

Embodiment 38 is a host cell comprising the vector of embodiment 37.

Embodiment 39 is a pharmaceutical composition, comprising the anti-CD33/anti-CD3 bispecific antibody or antigen-binding fragment thereof of any one of embodiments 26-35 and a pharmaceutically acceptable carrier.

Embodiment 40 is a method of treating cancer in a subject in need thereof, comprising administering to the subject the pharmaceutical composition of embodiment 39.

Embodiment 41 is the method of embodiment 40, wherein the cancer is a hematologic cancer.

Embodiment 42 is the method of embodiment 41, wherein the hematologic cancer is selected from the group consisting of a leukemia, a lymphoma, or a multiple myeloma.

Embodiment 43 is the method of embodiment 42, wherein the hematologic cancer is acute myeloid leukemia (AML), myelodysplastic syndrome (MDS), acute lymphocytic leukemia (ALL), diffuse large B-cell lymphoma (DLBCL), chronic myeloid leukemia (CML) or blastic plasmacytoid dendritic cell neoplasm (DPDCN).

Embodiment 44 is a method of producing the anti-CD33/anti-CD3 bispecific antibody or antigen-binding fragment thereof of any one of embodiments 26-35, comprising culturing a cell comprising a nucleic acid encoding the anti-CD33/anti-CD3 bispecific antibody or antigen-binding fragment under conditions to produce the anti-CD33/anti-CD3 bispecific antibody or antigen-binding fragment, and recovering the anti-CD33/anti-CD3 bispecific antibody or antigen-binding fragment from the cell or culture.

Embodiment 45 is a method of producing a pharmaceutical composition comprising the anti-CD33/anti-CD3 bispecific antibody or antigen-binding fragment of any one of embodiments 26-35, comprising combining the anti-CD33/anti-CD3 bispecific antibody or antigen-binding fragment thereof with a pharmaceutically acceptable carrier to obtain the pharmaceutical composition.

EXAMPLES

Reagents

Antigen Generation

The human and cyno CD33 proteins were produced with or without a mutated monomeric form of human serum albumin (HSA), Uniprot P02768 with a C58S mutation, fused at the C-terminus for immunizations and assays. The cDNAs encoding the CD33 protein antigens with a six-histidine tag, were synthetically synthesized and cloned into a mammalian secretion expression vector under the Actin promoter using standard molecular biology techniques.

The full-length human CD33 extracellular domain (ECD) derived from Uniprot P20138 (SEQ ID NO:1) (human CD33 ECD) was fused at the N-terminus with a signal sequence and with or without the HSA, followed by a six histidine tag at the C-terminus, hCD33 ECD with HSA and hCD33 ECD only). The human CD33 ECD expression construct was transiently transfected into HEK293 derived cells, EXPI293™ (GIBCO®/THERMO FISHER SCIENTIFIC®; Waltham, Mass.) using EXPIFECTAMINE™ according to manufacturer protocol. Cells were incubated 5 days at 37° C. with 8% $CO_2$ on an orbital shaker before harvesting. The expressed cells were removed by centrifugation and the soluble CD33 was purified from the media using immobilized metal affinity chromatography using Ni SEPHAROSE™ 6 Fast Flow resin (GE® Healthcare, Little Chalfont, United Kingdom) followed by SUPERDEX® 200 preparative size exclusion chromatography (SEC) (GE® Healthcare) in Dubelcco's Phosphate Saline buffer pH 7.2 (1xDPBS). SEC elution fractions excluding any disulfide aggregates were combined and sterile filtered to yield the final protein for immunization and CD33 assays. Protein concentration was determined by A280 and quality of purified protein was assessed by SDS-PAGE and analytical SEC (PHENOMENEX®; Torrance, Calif.). Endotoxin measurements were performed using ENDOSAFE®-PTS Cartridges, a chromogenic LAL assay (CHARLES RIIVER®; Wilmington, Mass.).

The human CD33 ECD subdomain proteins, hCD33 V-domain-HSA, hCD33 V-domain-his, hCD33 C2 domain-HSA, and hCD33 C2 domain-His, were similarly constructed, expressed and purified as the full-length human CD33 ECD.

Cyno CD33 constructs for immunization and cross selectivity assays, cyno CD33 ECD-HSA, cyno CD33-His, were also generated based on the Genbank sequence XP_005590138.1. Cyno CD33 protein expression and purification were same as the human CD33 proteins.

The CD33 antigens for screening were biotinylated in 50 mM Na Phosphate pH 7.2 using SURELINK™ Chromagenic Biotin Labeling kit (SERACARE® KPL) according to manufacturer conditions. Briefly, a biotin stock of 25 mM was added to the CD33 protein at a 4:1 molar ratio of biotin to protein and incubated at room temperature for 30 minutes with gentle rotation and then switched to 4° C. for 2 more hours. Unincorporated biotin was removed by buffer exchange into 1xDPBS. Protein concentration and biotin incorporation was determined by measuring at A280 nm and A354 nm using NanoDrop. See Table 1 for the sequences of each of the antigens described above.

TABLE 1

Antigen Sequences

| Protein Name | Protein ID | SEQ ID NO |
|---|---|---|
| Cyno CD33 ECD-HSA | C33W1 | 2 |
| Human CD33 ECD-HSA | C33W2 | 3 |
| Human CD33-V-HSA | C33W3 | 4 |
| Human CD33-C2-HSA | C33W4 | 5 |
| Human CD33-V-His | C33W8 | 6 |
| Human CD33 C2-His | C33W9 | 7 |
| Human CD33 ECD-His | C33W49 | 8 |
| Cyno CD33 ECD-His | C33W50 | 9 |
| Human CD33 full length | | 10 |
| Cyno CD33 full length | | 11 |

Generation of CD33 Expressing Isogenic Cell Lines

Human and cyno CD33 expressing cell lines were generated using lentivirus (GENECOPOEIA®; Rockville, Md.) containing full length human CD33 or cyno CD33 and puromycin for selection of CD33 positive cells. HEK293F cells (ATCC), negative for CD33, were transduced with lentiviral particles to overexpress human CD33 and cyno CD33. Following transduction, cells positively expressing CD33 and the resistance marker, were selected by treating pooled cells, grown in DMEM+10% HI FBS (LIFE TECHNOLOGIES™; Carlsbad, Calif.) and supplemented with varying concentrations of Puromycin (LIFE TECHNOLOGIES™).

In addition to the HEK generated cell lines, several commercial cell lines were used for binding and cellular toxicity assays. These included MOLM13, KG1, SH2, OCIAML3 and MV411 and were obtained from either American Type Culture Collection or Deutsche Sammlung von Mikrooranismen und Zellkulturen, and cultured at 37° C., 5% $CO_2$ in complete RPMI culture media with 10% FBS.

Example 1: Immunization Campaigns

OMNIRAT®

A human immunoglobulin transgenic rat strain (OMNIRAT®; Ligand Pharmaceuticals; San Diego, Calif.) was used to develop human CD33 monoclonal antibody expressing hybridoma cells. The OMNIRAT® contains a chimeric human/rat IgH locus (comprising 22 human $V_H$s, all human D and $J_H$ segments in natural configuration linked to the rat CH locus) together with fully human IgL loci (12 Vκs linked to Jκ-Cκ and 16 Vλs linked to Jκ-Cκ). (see e.g., Osborn, et al. (2013) J Immunol 190(4): 1481-1490). Accordingly, the rats exhibit reduced expression of rat immunoglobulin, and in response to immunization, the introduced human heavy and light chain transgenes undergo class switching and somatic mutation to generate high affinity chimeric human/rat IgG monoclonal antibodies with fully human variable regions. The preparation and use of OMNIRAT®, and the genomic modifications carried by such rats, is described in PCT Publication WO 2014/093908 to Bruggemann et al.

When immunized with recombinant human and cynomolgus CD33 (huCD33 ECD-HSA and cyno CD33 ECD-HSA respectively), this transgenic rat produces chimeric human-rat IgG antibodies to human CD33, some of which also bind to cynomolgus CD33.

Eight OMNIRATS® were immunized alternately with huCD33 ECD-HSA and cyno CD33 ECD-HSA. Following a 46 day immunization regimen, lymph nodes from all eight OMNIRATS® were harvested and used to generate hybridomas. Eighty-one 96-well plates of hybridoma supernatants were screened via binding ELISA and AlphaLISA using standard techniques, of which 128 hybridoma supernatants were selected for specific binding to huCD33 ECD-HSA and cyno CD33 ECD-HSA. Most of the 128 supernatants were also positive for binding to cells over-expressing huCD33 or cyCD33.

Six additional OMNIRATS® were immunized with rhuCD33 only. Following a 31 day immunization regimen, lymph nodes from all six OMNIRATS® were harvested and used to generate hybridomas. Thirty 96-well plates of hybridoma supernatants were screened via binding ELISA using standard techniques, of which 94 hybridoma supernatants were selected for specific binding to huCD33 ECD-HSA and cyno CD33 ECD-HSA. Hybridoma lysates were prepared from the positive clones and progressed to v region cloning described below.

OMNIMOUSE®

A human immunoglobulin transgenic mouse strain (OMNIMOUSE®; Ligand Pharmaceuticals) was used to develop human CD33 monoclonal antibody expressing hybridoma cells. The OMNIMOUSE® contains chimeric human/rat IgH loci together with fully human IgL loci. The mice exhibit reduced expression of mouse immunoglobulin, and in response to immunization, the introduced human heavy and light chain transgenes undergo class switching and somatic mutation to generate high affinity chimeric human/rat IgG monoclonal antibodies with fully human variable regions.

When immunized with recombinant human and cynomolgus CD33 (huCD33 ECD-HSA and cyno CD33 ECD-HAS respectively), this transgenic mouse produces chimeric human/rat IgG antibodies to human CD33, some of which also bind to cynomolgus CD33.

Four OMNIMICE® were immunized alternately with huCD33 ECD-HSA and cyno CD33 ECD-HSA. Following a 53 day immunization regimen, spleens and lymph nodes from all four OMNIMICE® were harvested and used to generate hybridomas. Forty-eight 96-well plates of hybridoma supernatants were screened via binding ELISA and AlphaLISA, of which 8 hybridoma supernatants were selected for specific binding to huCD33 ECD-HSA and cyno CD33 ECD-HSA. Hybridoma lysates were prepared from the positive clones and progressed to v region cloning described below.

V Region Cloning

Total RNA from hybridoma cell lysates was purified using RNeasy 96 kit (QIAGEN®; Hilden, Germany) following the manufacturer's protocol, and the resulting RNA was quantitated using Drop Sense and stored at −80° C. or cDNA was synthesized using INVITROGEN® SUPERSCRIPT® III First-Strand Synthesis System for RT-PCR (INVITROGEN®; Carlsbad, Calif.). The first strand cDNA Synthesis was carried out using gene specific primers annealed to the constant regions of heavy, kappa, and lambda chains, respectively. The RT-PCR reaction mixture is comprised of up to 3 μg of purified RNA, gene specific primer, dNTP mix, reaction buffer, 25 mM MgCl$_2$, DTT, RNASEOUT® (40 U/μl, INVITROGEN®), and SUPERSCRIPT® III RT (200 U/μl, INVTTROGEN® Cat #18080-051), and incubate at 50° C. for 50 minutes and 85° C. for 5 minutes. The resulting single-stranded cDNA was stored at −20° C., or the single-stranded DNA was PCR amplified. The PCR reaction was carried out using PLATINUM™ Pfx polymerase (INVITROGEN®). The v-region fragments were amplified by forward and reverse primers annealing to the leader sequences and constant regions of heavy, kappa and lambda chains, respectively, using optimized PCR conditions. The resulting PCR fragments were run on the gel and sequenced at GENEWIZ® using pre-designed primers to obtain v-region sequences. The resulting abi files of v-region sequences were collected and analyzed by the Sanger v-region sequence analysis program created at Janssen Biologics Discovery. The AA sequences of the recovered v-regions were registered in the internal database, codon optimized and cloned into the pUnder-based expression vector carrying the appropriate constant region of the desired human antibody isotype: IgG1 F405L and IgG4 PAA. A total of 76 OMNIRAT® antibodies and 8 OMNIMOUSE® antibodies were successfully cloned and proceeded for further characterization. The tables below summarize the sequences from the top 42 identified in the OMNIRAT® campaigns (see Table 2) and the 16 identified in the OMNIMOUSE® campaign (see Table 3) with several of the OMNIRAT® antibodies cloned into IgG1 as well as IgG4 PAA and all from the OMNIMOUSE® campaign were cloned into both IgG1 and IgG 4 PAA.

TABLE 2

Antibody sequences identified via CD33 immunization in OMNIRAT®

| mAb | HC ID | HC Isotype | Protein SEQ ID | Nucleotide SEQ ID | LC ID | Protein SEQ ID | Nucleotide SEQ ID |
| --- | --- | --- | --- | --- | --- | --- | --- |
| C33B46 | C33H108 | huIgG1F405L | 12 | 54 | C33L74 | 96 | 138 |
| C33B48 | C33H80 | huIgG1F405L | 13 | 55 | C33L73 | 97 | 139 |
| C33B52 | C33H42 | huIgG1F405L | 14 | 56 | C33L8 | 98 | 140 |
| C33B54 | C33H44 | huIgG1F405L | 15 | 57 | C33L10 | 99 | 141 |
| C33B55 | C33H45 | huIgG1F405L | 16 | 58 | C33L11 | 100 | 142 |
| C33B56 | C33H46 | huIgG1F405L | 17 | 59 | IAPL24 | 101 | 143 |
| C33B61 | C33H48 | huIgG1F405L | 18 | 60 | C33L58 | 102 | 144 |
| C33B62 | C33H49 | huIgG1F405L | 19 | 61 | C33L59 | 103 | 145 |
| C33B63 | C33H51 | huIgG1F405L | 20 | 62 | C33L34 | 104 | 146 |
| C33B64 | C33H52 | huIgG1F405L | 21 | 63 | N46L109 | 105 | 147 |
| C33B66 | C33H55 | huIgG1F405L | 22 | 64 | C33L42 | 106 | 148 |
| C33B72 | C33H65 | huIgG1F405L | 23 | 65 | C33L47 | 107 | 149 |
| C33B73 | C33H66 | huIgG1F405L | 24 | 66 | C33L60 | 108 | 150 |
| C33B75 | C33H70 | huIgG1F405L | 25 | 67 | N46L109 | 109 | 151 |
| C33B77 | C33H72 | huIgG1F405L | 26 | 68 | C33L40 | 110 | 152 |
| C33B79 | C33H74 | huIgG1F405L | 27 | 69 | C33L38 | 111 | 153 |
| C33B80 | C33H76 | huIgG1F405L | 28 | 70 | C33L39 | 112 | 154 |
| C33B82 | C33H78 | huIgG1F405L | 29 | 71 | C33L57 | 113 | 155 |
| C33B83 | C33H81 | huIgG1F405L | 30 | 72 | C33L53 | 114 | 156 |
| C33B87 | C33H87 | huIgG1F405L | 31 | 73 | C33L35 | 115 | 157 |
| C33B88 | C33H88 | huIgG1F405L | 32 | 74 | C33L61 | 116 | 158 |
| C33B89 | C33H90 | huIgG1F405L | 33 | 75 | C33L51 | 117 | 159 |
| C33B94 | C33H98 | huIgG1F405L | 34 | 76 | C33L69 | 118 | 160 |
| C33B95 | C33H98 | huIgG1F405L | 35 | 77 | IAPL24 | 119 | 161 |
| C33B96 | C33H99 | huIgG1F405L | 36 | 78 | C33L37 | 120 | 162 |
| C33B101 | C33H69 | huIgG1F405L | 37 | 79 | C4LL152 | 121 | 163 |
| C33B107 | C33H68 | huIgG1F405L | 38 | 80 | C33L17 | 122 | 164 |
| C33B120 | C33H87 | huIgG1F405L | 39 | 81 | C33L41 | 123 | 165 |
| C33B122 | C33H92 | huIgG1F405L | 40 | 82 | C33L30 | 124 | 166 |
| C33B123 | C33H91 | huIgG1F405L | 41 | 83 | C33L44 | 125 | 167 |
| C33B124 | C33H73 | huIgG1F405L | 42 | 84 | C33L32 | 126 | 168 |
| C33B125 | C33H84 | huIgG1F405L | 43 | 85 | C33L66 | 127 | 169 |
| C33B760 | C33H45 | huIgG4 PAA | 44 | 86 | C33L11 | 128 | 170 |
| C33B777 | C33H65 | huIgG4 PAA | 45 | 87 | C33L47 | 129 | 171 |
| C33B778 | C33H66 | huIgG4 PAA | 46 | 88 | C33L60 | 130 | 172 |

TABLE 2-continued

Antibody sequences identified via CD33 immunization in OMNIRAT®

| mAb | HC ID | HC Isotype | Protein SEQ ID | Nucleotide SEQ ID | LC ID | Protein SEQ ID | Nucleotide SEQ ID |
|---|---|---|---|---|---|---|---|
| C33B782 | C33H72 | huIgG4 PAA | 47 | 89 | C33L40 | 131 | 173 |
| C33B792 | C33H87 | huIgG4 PAA | 48 | 90 | C33L35 | 132 | 174 |
| C33B799 | C33H98 | huIgG4 PAA | 49 | 91 | C33L69 | 133 | 175 |
| C33B806 | C33H69 | huIgG4 PAA | 50 | 92 | C4LL152 | 134 | 176 |
| C33B830 | C33H84 | huIgG4 PAA | 51 | 93 | C33L66 | 135 | 177 |
| C33B836 | C33H80 | huIgG4 PAA | 52 | 94 | C33L73 | 136 | 178 |
| C33B937 | C33H66 | huIGG4 PAA | 53 | 95 | C33L132 | 137 | 179 |

HC: Heavy Chain;
LC: Light Chain

TABLE 3

Antibody sequences identified via CD33 immunization in OMNIMOUSE®

| mAb | HC ID | Protein SEQ ID NO | Nucleotide SEQ ID NO | LC ID | Protein SEQ ID NO | Nucleotide SEQ ID NO |
|---|---|---|---|---|---|---|
| C33B901 | C33H249 | 180 | 196 | C33L115 | 212 | 228 |
| C33B902 | C33H250 | 181 | 197 | C33L116 | 213 | 229 |
| C33B903 | C33H251 | 182 | 198 | C33L117 | 214 | 230 |
| C33B904 | C33H252 | 183 | 199 | C33L118 | 215 | 231 |
| C33B905 | C33H253 | 184 | 200 | C33L119 | 216 | 232 |
| C33B906 | C33H254 | 185 | 201 | C33L120 | 217 | 233 |
| C33B907 | C33H255 | 186 | 202 | C33L121 | 218 | 234 |
| C33B908 | C33H256 | 187 | 203 | C33L122 | 219 | 235 |
| C33B909 | C33H249 | 188 | 204 | C33L115 | 220 | 236 |
| C33B910 | C33H250 | 189 | 205 | C33L116 | 221 | 237 |
| C33B911 | C33H251 | 190 | 206 | C33L117 | 222 | 238 |
| C33B912 | C33H252 | 191 | 207 | C33L118 | 223 | 239 |
| C33B913 | C33H253 | 192 | 208 | C33L119 | 224 | 240 |
| C33B914 | C33H254 | 193 | 209 | C33L120 | 225 | 241 |
| C33B915 | C33H255 | 194 | 210 | C33L121 | 226 | 242 |
| C33B916 | C33H256 | 195 | 211 | C33L122 | 227 | 243 |

HC: Heavy Chain;
LC: Light Chain

EXPI293™ Small Scale Transfection and Purification

Antibodies identified in the immunization campaigns and subsequent v region cloning (into IgG1 F405L and IgG4 PAA) were expressed and purified via small 2 ml scale. EXPI293™ cells (THERMO FISHER SCIENTIFIC®) were seeded at $1.25 \times 10^{-5}$-$2.25 \times 10^5$ viable cells/mL density in EXPI293™ Expression Medium and cultured in polycarbonate, disposable, sterile, vented, non-baffled Erlenmeyer shake flasks in a 37° C., 7% $CO_2$ shaker incubator (INFORS HT™ MULTITRON PRO™). For routine cell growth in 125 mL-2 L shake flasks, the shake speed was set to 130 rpm for shakers with a 19 mm shaking diameter. Cells were subcultured when density reached log phase growth at $3 \times 10^6$-$5 \times 10^6$ viable cells/mL with a 98-99% viability.

On day of transfection, the viable cell density and percent viability was determined. Cells were transfected at a density of $3 \times 10^6$ viable cells/mL. For optimal transfection, sterile Heavy and Light Chain plasmid DNA at 0.1 mg/mL concentration in TE buffer (10 mM Tris-HCl, 1 mM EDTA, pH 8.0) is used.

EXPI293™ cells were transfected following manufacturer's Transfection protocol (THERMO FISHER SCIENTIFIC® Publication Number MAN0007814). Transfection was performed in 24-well deepwell plates (GE® Healthcare). Briefly, plasmid DNA was diluted with 0.1 mL OptiMEM™ medium (THERMO FISHER SCIENTIFIC®) at the following ratio: 0.250 µg Heavy Chain DNA: 0.750 µg Light Chain DNA: 0.5 µg pAdvantage. 5 µL of EXPIFECTAMINE™ 293 Transfection Reagent was diluted and mixed gently with 95 µL OptiMEM™ medium and incubated for 1 min. The diluted EXPIFECTAMINE™ 293 Reagent was added to the diluted DNA, mixed gently and the EXPIFECTAMINE™ 293/plasmid DNA complexes were incubated at room temperature for 40 minutes. Post-incubation, 1.8 mL Expi293™ cells were added to the complexes incubated overnight in a 37° C., 7% $CO_2$ shaker incubator.

On Day 1 post-transfection, 10 µL EXPIFECTAMINE™ 293 Enhancer land 100 µL EXPIFECTAMINE™ Enhancer 2 were added and the plates were returned to the incubator for an additional 5 days. The culture was harvested on day 6 post-transfection by centrifugation at 850×G for 15 minutes before purification.

1.7 mls of clarified expression supernatants prepared above were transferred to a new 96 2 ml deepwell plate. Purification plates were prepared by pipetting 800 µl of a 1:4 mix of mAb Select Sure resin (GE® Healthcare) and DPBS −/− slurry into every well of a 96 well ACROPREP™ Advance 1 µm glass filter plate (PALL®). 200 mbar of vacuum pressure was applied to the plate to remove excess PBS and subsequently washed with 800 µl fresh PBS. 200 mbar vacuum pressure was applied to remove the wash buffer. The clarified supernatants were then transferred to the PBS washed resin, mixed gently and incubated for 15 minutes. Following the incubation, 200 mbar vacuum pressure was applied to remove the supernatant. The mAb Select Sure resin was washed three times with PBS and once with 25 mM Sodium Acetate, pH 5 (TEKNOVA; Hollister, Calif.) with 200 mbar vacuum pressure applied between washes to remove excess buffer. mAbs bound to the resin were eluted using 0.1 M Sodium Acetate, pH 3.5 and incubated for 10 minutes for effective dissociation. The filter plate was placed atop a 96 deepwell plate and the eluted mAbs were collected in the bottom plate via centrifugation at 1000 g for 2 minutes. 80 µl of 2.5 M Tris-Actetate, pH 7.2 was added to neutralize the mAbs. The mAbs were dialyzed into PBS overnight in a 96 well DispoDIALYZER plate (Harvard Apparatus; Holliston, Mass.), transferred to a 96 well ACROPREP™ Advance 0.2 µm Supor filter plate (PALL®; Port Washington, N.Y.), placed atop a 96 deepwell plate and the protein solutions filtered via centrifugation at 1,500 g for 15 minutes in a desktop centrifuge. Protein concentrations were determined by A280 measurement on the filtrate using a DROPSENSE™ Instrument (TRINEAN™).

Example 2: Characterization of Anti-CD33 mAbs

OMNIRAT® antibodies identified via immunization, v-region cloned and subsequently expressed and purified were characterized further for binding to CD33 expressing cells and binding to recombinant antigens. The purified antibodies were assessed for binding to stably transfected HEK293F cells expressing human CD33 or cyno CD33 (generation described above) along with the parental HEK293F as negative control. Cells were harvested from tissue culture flasks using non-enzymatic dissociation buffer (THERMO FISHER SCIENTIFIC®). The flasks were rinsed twice with PBS and dissociation buffer was added to the flask, and the flask was incubated for 10 minutes at 37° C. until the cells became non-adherent. The cells were centrifuged at 300 g for 5 minutes and resuspended at $1.0 \times 10^6$ cells/ml in staining buffer (Becton Dickinson; Franklin Lakes, N.J.). 50,000 cells/well of each cell type was plated in 50 µl of staining buffer in round bottom plates (Becton Dickinson). 50 µl of 2× concentration test mAb or isotype control was added at 3 dilutions and zero (120 nM, 12 nM, and 1.2 nM and 0 nM), and the resultant solution was incubated 30 min at 4° C. 100 µl staining buffer was added to all wells of each plate, the plates were spun at 300 g for 5 min, the buffer was removed, 200 µl staining buffer was added to all wells of each plate, the plates were spun at 300 g for 5 min, and the buffer was removed. 50 µl of 2 µg/ml of Goat-anti-human Fc AF647 secondary antibody (Jackson Immunoresearch; West Grove, Pa.) was added to all wells of the plates, and the plates were incubated for 30 min at 4° C. 100 µl staining buffer was added to all wells of the plates, the plates were spun at 300 g for 5 min, and the buffer was removed. 200 µl running buffer (running buffer is Staining buffer, 1 mM EDTA, 0.1% Pluronic Acid) was added to all wells of the plates, the plates were spun at 300 g for 5 min, and the buffer was removed. 30 ul running buffer containing Sytox Green live/dead dye (THERMO FISHER SCIENTIFIC®) was added to all wells with cells and the plates were read on an iQue IntelliCyt flow cytometer. Cells were gated on forward vs. side scatter to eliminate debris, then on singlets and then on live cells which excluded the Sytox stain. Antibody binding was assessed by the mean fluorescence intensity in the AF647 channel.

To begin assessing the biophysical binding properties of the purified mAbs an off-rate screen was performed. 76 OMNIRAT® anti-CD33 mAbs were tested for binding to recombinant human CD33 ECD-HSA (C33W2) and cyno CD33 ECD-HSA (C33W1) proteins (Janssen production) and the off-rate was measured by IBIS MX96 SPRi array platform (Carterra; Newton, Pa.). Goat anti-human Fc IgG (Jackson Immunoresearch, Cat #109-005-098) was directly immobilized via amine coupling at 100 µg/mL in acetate buffer, pH 4.5 using a CMD50m sensor chip (Xantec, lot CMD50m0415.a) with an association time of 10 minutes in the IBIS instrument. An average GAH-Fc immobilization level of ~9000 Rus was achieved. The sensor chip was transferred to the Continuous Flow Microspotter (CFM) unit to capture each anti-CD33 mAb at 10 µg/ml for 10 minutes. Binding was measured on IBIS SPRi by single cycle kinetics without regeneration. Each antigen concentration series (3 µM in 3 fold dilution series) was sequentially injected from low (0.46 nM) to high concentrations (3 µM) to bind to captured mAbs with an association time of 5 minutes and dissociation time of 15 minutes using PBST (PBS with 0.005% TWEEN) as running buffer. The raw binding data (.trix file format) were referenced and aligned using SprintX software (Wasatch, Ver 1.9.3.2), then exported (.ibmx file format) to Scrubber software (Ver. 2.0) for 1:1 binding kinetic analyses (Wasatch, version 2.0.0.33) to extract the $k_{off}$ results.

Table 4 below summarizes the top 32 clones as assessed by binding to human and cyno CD33 expressing cell lines as well as towards recombinant antigen (off-rate of at least >10e-3 for one of the antigens). Of these 32, all but 4 showed appreciable binding to either human or cyno expressing cells. All 32 were carried for further characterization via epitope binning and full kinetic analysis.

TABLE 4

Cell Binding and Off-Rate analysis of the anti-CD33 antibodies derived from OMNIRAT ®

| Prot. AA ID | % Mon | 60 nM CD33 | 6 nM CD33 | 0.6 nM CD33 | 0 nM CD33 | kD |
|---|---|---|---|---|---|---|
| C33B48 | 91.96 | 400995.84 | 428948.75 | 391157.69 | 91.12 | 5.47E−05 |
| C33B73 | 100.00 | 201493.02 | 33443.28 | 4034.64 | 93.98 | 9.12E−05 |
| C33B125 | 98.48 | 258779.13 | 79728.78 | 9203.75 | 78.26 | 1.54E−04 |
| C33B55 | 96.39 | 188278.42 | 59155.10 | 7625.56 | 105.39 | 2.15E−04 |
| C33B96 | 98.75 | 476040.28 | 475653.41 | 187925.80 | 55.23 | 2.28E−04 |
| C33B124 | 100.00 | 798.33 | 126.37 | 90.26 | 172.03 | 2.38E−04 |
| C33B72 | 96.94 | 328194.72 | 105474.59 | 12506.85 | 93.32 | 2.84E−04 |
| C33B79 | 100.00 | 236644.03 | 41925.89 | 4988.81 | 77.78 | 3.28E−04 |
| C33B77 | 92.11 | 241787.16 | 88691.05 | 11484.97 | 69.46 | 3.37E−04 |
| C33B82 | 96.21 | 188508.56 | 41264.92 | 5033.60 | 73.44 | 3.41E−04 |

TABLE 4-continued

Cell Binding and Off-Rate analysis of the anti-CD33 antibodies derived from OMNIRAT ®

| Prot. AA ID | | | | | |
|---|---|---|---|---|---|
| C33B87 | 100.00 | 242185.48 | 79532.87 | 12547.05 | 73.65 | 3.52E-04 |
| C33B80 | 98.33 | 5799.64 | 409.97 | 114.93 | 88.88 | 3.84E-04 |
| C33B101 | 96.91 | 268805.28 | 204984.16 | 35513.63 | 70.07 | 3.98E-04 |
| C33B83 | 98.07 | 92956.55 | 7856.70 | 1020.48 | 87.37 | 4.61E-04 |
| C33B46 | 95.81 | 509865.97 | 447627.97 | 418017.22 | 134.53 | 4.67E-04 |
| C33B94 | 98.31 | 200142.00 | 93852.22 | 13274.87 | 89.59 | 5.38E-04 |
| C33B88 | 98.36 | 393148.13 | 481100.91 | 274293.53 | 94.81 | 8.25E-04 |
| C33B66 | 98.71 | 444680.31 | 313288.41 | 56628.04 | 129.73 | 8.59E-04 |
| C33B120 | 97.63 | 190036.14 | 60357.11 | 7054.28 | 92.94 | 1.40E-03 |
| C33B64 | 98.13 | 200158.36 | 54138.77 | 7556.04 | 114.85 | 1.71E-03 |
| C33B52 | 96.76 | 196557.09 | 46286.13 | 6751.01 | 82.46 | 3.13E-03 |
| C33B56 | 95.59 | 143.73 | 79.73 | 111.95 | 138.04 | 4.02E-03 |
| C33B75 | 98.68 | 163795.25 | 29603.57 | 4517.81 | 95.94 | 4.16E-03 |
| C33B107 | 96.90 | 375388.25 | 339798.53 | 161369.64 | 86.54 | 4.44E-03 |
| C33B63 | 98.79 | 247758.77 | 62221.71 | 9671.48 | 86.34 | 4.57E-03 |
| C33B95 | 97.77 | 154556.58 | 44354.07 | 6402.00 | 87.38 | 5.99E-03 |
| C33B61 | 98.87 | 198777.34 | 38699.10 | 5308.45 | 79.84 | 6.71E-03 |
| C33B89 | 100.00 | 315.38 | 119.12 | 65.61 | 70.94 | 8.11E-03 |
| C33B122 | 98.49 | 259183.69 | 84281.03 | 14291.17 | 65.01 | 8.74E-03 |
| C33B62 | 99.05 | 157786.36 | 37359.44 | 6092.03 | 75.00 | 1.00E-02 |
| C33B123 | 95.08 | 224078.95 | 88155.99 | 8864.39 | 71.05 | 1.03E-02 |
| C33B54 | 100.00 | 147753.30 | 27461.06 | 3766.69 | 61.26 | 2.48E-02 |

| Prot. AA ID | 60 nM Cyno CD33 | 6 nM Cyno CD33 | 0.6 nM Cyno CD33 | 0 nM Cyno CD33 | Cyno CD33 binding kD |
|---|---|---|---|---|---|
| C33B48 | 56491.32 | 47326.85 | 43351.12 | 94.01 | 1.20E-04 |
| C33B73 | 14799.14 | 6987.92 | 795.57 | 72.51 | 4.08E-04 |
| C33B125 | 15603.45 | 11526.47 | 3458.27 | 70.22 | 3.51E-04 |
| C33B55 | 16020.78 | 9994.42 | 2433.94 | 69.38 | 1.16E-04 |
| C33B96 | 37273.19 | 20087.29 | 11574.59 | 86.31 | 8.19E-04 |
| C33B124 | 593.00 | 132.19 | 77.26 | 98.41 | 4.77E-04 |
| C33B72 | 19422.07 | 13975.14 | 3894.84 | 90.81 | 7.63E-04 |
| C33B79 | 15538.97 | 6427.73 | 1082.85 | 63.59 | 6.82E-03 |
| C33B77 | 17516.20 | 11665.49 | 3601.76 | 85.23 | 4.18E-04 |
| C33B82 | 14269.38 | 6622.07 | 1540.09 | 84.24 | 6.70E-04 |
| C33B87 | 19597.18 | 12652.44 | 3266.36 | 103.07 | 2.28E-04 |
| C33B80 | 4612.58 | 248.60 | 108.93 | 82.38 | 2.66E-04 |
| C33B101 | 48016.75 | 46115.96 | 17989.37 | 79.69 | 1.06E-04 |
| C33B83 | 5304.40 | 687.44 | 159.37 | 87.35 | 2.17E-03 |
| C33B46 | 49840.14 | 49816.36 | 49729.78 | 92.05 | 1.48E-04 |
| C33B94 | 16126.84 | 10782.54 | 3183.70 | 87.82 | 5.37E-04 |
| C33B88 | 50388.18 | 43928.95 | 43940.23 | 90.13 | 3.89E-04 |
| C33B66 | 48905.04 | 49076.39 | 42160.22 | 77.96 | 9.33E-05 |
| C33B120 | 13211.32 | 7865.37 | 2726.18 | 75.77 | 8.54E-04 |
| C33B64 | 21109.59 | 9685.04 | 3102.56 | 99.82 | 1.21E-03 |
| C33B52 | 12582.90 | 8444.39 | 2063.44 | 75.24 | 1.20E-03 |
| C33B56 | 104.27 | 85.94 | 78.56 | 83.31 | 8.46E-04 |
| C33B75 | 12194.41 | 5577.80 | 1709.40 | 124.32 | 1.20E-03 |
| C33B107 | 50325.07 | 47810.05 | 36786.69 | 55.11 | 1.35E-04 |
| C33B63 | 18322.71 | 11642.38 | 2879.89 | 87.94 | 9.47E-04 |
| C33B95 | 14774.34 | 9594.12 | 1637.99 | 80.81 | 6.98E-03 |
| C33B61 | 13552.71 | 8211.09 | 1595.90 | 106.84 | 1.83E-03 |
| C33B89 | 47301.14 | 34193.78 | 23334.20 | 112.80 | 4.65E-05 |
| C33B122 | 19740.29 | 13907.32 | 5838.25 | 82.53 | 1.45E-03 |
| C33B62 | 12737.71 | 5620.17 | 1922.97 | 934.44 | 1.32E-03 |
| C33B123 | 10665.93 | 10404.03 | 3232.18 | 61.08 | 2.74E-03 |
| C33B54 | 50466.68 | 43011.75 | 38091.89 | 28785.80 | 1.35E-04 |

The panel of mAbs was then further characterized for full affinity analysis as well as epitope binning. The binding of anti-CD33 mAbs to recombinant human CD33 ECD-HSA (C33W2) and cyno CD33 ECD-HSA (C33W1) was measured by ProteOn SPR (Bio-Rad). Goat anti-human Fc IgG (Jackson Immunoresearch, Cat #109-005-098) was directly immobilized via amine coupling at 30 gig/mL in acetate buffer, pH 5.0 on all 6 ligand channels in vertical orientation on a GLC Sensor Chip (Bio-Rad, catalog no. 176-5011) with a flow rate of 30 µL/min in PBS containing 0.005% TWEEN®-20. The immobilization densities averaged about 5000 Response Units (RU) with less than 5% variation among different channels. Different mAbs were captured on the anti-human Fc IgG surface at 0.25 or 0.5 µg/ml (160-300 RU) in vertical ligand orientation, with the 6$^{th}$ ligand channel as no ligand surface control. Human and cyno CD33-HSA proteins at 0.3 µM concentration in 3-fold dilution series of 5 concentrations flew in as analyte to bind to captured mAbs in the horizontal orientation. A buffer sample was also injected in the 6 channel to monitor the dissociation of captured mAb and baseline stability. The dissociation phase for all concentrations of human and cyno CD33-HSA was monitored at a flow rate of 100 µL/min for 15 minutes for binding to C33B782, 60 minutes for binding to C33B912 (identical to C33B904 with hIgG4), followed by regeneration using an 18 second pulse of 0.85% phosphoric acid to remove the antigen and the bound mAb. The raw biding data were processed by double referencing after subtracting the response data from: 1) the inter-spot to correct for the non-specific interactions between the Ag and the empty chip surface; 2) the buffer channel to correct for baseline drifting due to the dissociation of captured mAb surface over time. The processed data at all antigen concentrations for each mAb were globally fit to a 1:1 simple Langmuir binding model to extract estimates of the kinetic ($k_{on}$, $k_{off}$) and affinity (KD) constants.

To determine whether the panel of mAbs all bind 1 distinct epitope or if there was broad epitope coverage, an epitope binning experiment was performed. Competitive epitope binning of CD33 mAbs was performed on an IBIS SPRi instrument (Carterra) using a CMD-200M sensor prism chip. Each anti-CD33 antibody was directly immobilized via amine coupling on the chip at 10 µg/ml in acetate buffer (pH 4.5) using a separate Continuous Flow Microspotter (CFM). Printed sensor chip was then transferred to the IBIS instrument for the binning analyses using a Classical or "Sandwich" binning format. Binning was performed by sequential injection of human CD33 ECD-HSA, (C33W2) at 50 nM followed by a single anti-CD33 mAb injection as competing analyte in solution at 133 nM to bind immobilized anti-CD33 mAbs with surface regeneration after each sequential injection cycle of antigen and antibody.

To monitor the activity of the immobilized mAbs before and after regeneration, a buffer injection without any competing mAb was performed at the beginning and at the end of the experiment to measure the antigen alone binding activity. The response of competing mAb binding relative to the buffer (antigen alone) binding is an indication whether the antibody in solution blocks or sandwiches the antigen binding to the immobilized mAbs. The raw binning data (.trix file format) were referenced and zeroed using SprintX software (Wasatch, Ver 1.9.3.2), then exported (.ibmx file format) to the binning software HtTools.exe (Wasatch, version 2.0.0.33) for analyses. Data were curated by removing antibodies with antigen responses below 20 RU, and antibodies that did not self-block. Competing mAb responses were normalized relative to the antigen alone binding response. Antibodies with normalized responses <0.25 were denoted blockers, those with normalized responses ≥0.25 were denoted as non-blockers/Sandwichers. Different bins were predicted using a cut at height 2.5 on the combined dendrogram plot.

The table below summarizes the full kinetic analysis and epitope binning of 32 select mAbs. There are a total of 8 anti-CD33 mAbs that have sub-nanomolar affinity for both human and cyno CD33 and these mAbs correspond to 3 distinct epitope bins while the larger panel has a range of affinities and 7 distinct epitope bins.

TABLE 5

Full Kinetics Analysis and Epitope Binning of OMNIRAT ® derived mAbs

| Prot. AA ID | V Region ID | ka (1/Ms) | kd (1/s) | KD (M) | Epitope Bin |
|---|---|---|---|---|---|
| Human CD33 ECD-HSA | | | | | |
| C33B48 | C33F53 | 1.62E+06 | 1.82E−05 | 1.12E−11 | 1 |
| C33B46 | C33F51 | 1.45E+06 | 1.99E−03 | 1.38E−09 | 1 |
| C33B66 | C33F71 | 3.85E+04 | 2.03E−03 | 5.29E−08 | 1 |
| C33B107 | C33F112 | binding/no fit | binding/no fit | binding/no fit | 1 |
| C33B88 | C33F93 | binding/no fit | binding/no fit | binding/no fit | 1 |
| C33B96 | C33F101 | 2.26E+05 | 4.36E−04 | 1.92E−09 | 3 |
| C33B101 | C33F106 | 1.62E+05 | 1.08E−03 | 6.64E−09 | 3 |
| C33B73 | C33F78 | 5.59E+05 | 5.59E−05 | 1.00E−10 | 4 |
| C33B125 | C33F130 | 9.92E+05 | 1.34E−04 | 1.40E−10 | 4 |
| C33B55 | C33F60 | 9.85E+05 | 2.53E−04 | 2.60E−10 | 4 |
| C33B82 | C33F87 | 4.45E+05 | 2.70E−04 | 6.10E−10 | 4 |
| C33B83 | C33F88 | 2.70E+05 | 5.21E−04 | 1.93E−09 | 4 |
| C33B75 | C33F80 | 3.85E+05 | 4.41E−03 | 1.14E−08 | 4 |
| C33B123 | C33F128 | 1.02E+06 | 1.52E−02 | 1.48E−08 | 4 |
| C33B52 | C33F57 | 2.06E+05 | 3.96E−03 | 1.92E−08 | 4 |
| C33B61 | C33F66 | 4.89E+05 | 1.05E−02 | 2.14E−08 | 4 |
| C33B62 | C33F67 | 5.07E+05 | 1.26E−02 | 2.49E−08 | 4 |
| C33B64 | C33F69 | 4.33E+05 | 2.21E−03 | 5.10E−09 | 4 |
| C33B63 | C33F68 | 5.33E+05 | 3.74E−03 | 7.01E−09 | 4 |
| C33B122 | C33F127 | 7.47E+05 | 7.12E−03 | 9.53E−09 | 4 |
| C33B72 | C33F77 | 8.71E+05 | 2.00E−04 | 2.30E−10 | 5 |
| C33B79 | C33F84 | 5.15E+05 | 3.90E−04 | 7.60E−10 | 5 |
| C33B77 | C33F82 | 8.28E+05 | 2.62E−04 | 3.20E−10 | 6 |
| C33B87 | C33F92 | 7.20E+05 | 4.32E−04 | 6.00E−10 | 6 |
| C33B94 | C33F99 | 9.22E+05 | 5.85E−04 | 6.30E−10 | 6 |
| C33B95 | C33F100 | 4.82E+05 | 7.40E−03 | 1.54E−08 | 6 |
| C33B120 | C33F125 | 5.75E+05 | 1.68E−03 | 2.93E−09 | 6 |
| C33B89 | C33F94 | low binding | low binding | low binding | 8 |
| C33B54 | C33F59 | low binding | low binding | low binding | 9 |
| C33B124 | C33F129 | 3.57E+05 | 1.24E−04 | 3.50E−10 | NB |
| C33B80 | C33F85 | 3.23E+05 | 4.25E−04 | 1.32E−09 | NB |
| C33B56 | C33F61 | low binding | low binding | low binding | NB |
| Cyno CD33 ECD-HSA | | | | | |
| C33B48 | C33F53 | 4.31E+06 | 1.58E−04 | 3.66E−11 | 1 |
| C33B46 | C33F51 | 2.97E+06 | 3.75E−04 | 1.26E−10 | 1 |
| C33B66 | C33F71 | 1.22E+06 | 2.66E−04 | 2.17E−10 | 1 |
| C33B107 | C33F112 | 3.31E+05 | 7.01E−05 | 2.12E−10 | 1 |
| C33B88 | C33F93 | binding/no fit | binding/no fit | binding/no fit | 1 |
| C33B96 | C33F101 | binding/no fit | binding/no fit | binding/no fit | 3 |
| C33B101 | C33F106 | 2.25E+05 | 2.69E−04 | 1.20E−09 | 3 |

TABLE 5-continued

Full Kinetics Analysis and Epitope Binning of OMNIRAT ® derived mAbs

| Prot. AA ID | V Region ID | ka (1/Ms) | kd (1/s) | KD (M) | Epitope Bin |
|---|---|---|---|---|---|
| C33B73 | C33F78 | 6.00E+05 | 5.08E−04 | 8.46E−10 | 4 |
| C33B125 | C33F130 | 1.12E+06 | 3.39E−04 | 3.04E−10 | 4 |
| C33B55 | C33F60 | 1.16E+06 | 8.37E−05 | 7.23E−11 | 4 |
| C33B82 | C33F87 | 5.45E+05 | 7.51E−04 | 1.38E−09 | 4 |
| C33B83 | C33F88 | 2.47E+05 | 2.88E−03 | 1.17E−08 | 4 |
| C33B75 | C33F80 | 6.16E+05 | 1.32E−03 | 2.15E−09 | 4 |
| C33B123 | C33F128 | 1.26E+06 | 3.39E−03 | 2.69E−09 | 4 |
| C33B52 | C33F57 | 3.13E+05 | 1.48E−03 | 4.74E−09 | 4 |
| C33B61 | C33F66 | 7.34E+05 | 1.62E−03 | 2.21E−09 | 4 |
| C33B62 | C33F67 | 8.05E+05 | 1.49E−03 | 1.85E−09 | 4 |
| C33B64 | C33F69 | 5.90E+05 | 1.01E−03 | 1.71E−09 | 4 |
| C33B63 | C33F68 | 7.23E+05 | 8.80E−04 | 1.22E−09 | 4 |
| C33B122 | C33F127 | binding/no fit | binding/no fit | binding/no fit | 4 |
| C33B72 | C33F77 | 9.19E+05 | 5.40E−04 | 5.87E−10 | 5 |
| C33B79 | C33F84 | 5.48E+05 | 2.20E−03 | 4.01E−09 | 5 |
| C33B77 | C33F82 | 1.08E+06 | 2.66E−04 | 2.47E−10 | 6 |
| C33B87 | C33F92 | 1.12E+06 | 2.64E−04 | 2.36E−10 | 6 |
| C33B94 | C33F99 | 1.10E+06 | 5.20E−04 | 4.73E−10 | 6 |
| C33B95 | C33F100 | 8.44E+05 | 8.06E−03 | 9.56E−09 | 6 |
| C33B120 | C33F125 | 8.76E+05 | 9.02E−04 | 1.03E−09 | 6 |
| C33B89 | C33F94 | 2.65E+05 | 2.01E−04 | 7.60E−10 | 8 |
| C33B54 | C33F59 | 1.32E+06 | 6.37E−04 | 4.84E−10 | 9 |
| C33B124 | C33F129 | 4.67E+05 | 4.72E−04 | 1.01E−09 | NB |
| C33B80 | C33F85 | 4.92E+05 | 2.59E−04 | 5.27E−10 | NB |
| C33B56 | C33F61 | low binding | low binding | low binding | NB |

The ONIMOUSE® panel (8 mAbs total) was generated separately and characterized further for binding to cells. Cell binding was performed as described above and summarized in the table below. Of the 8 mAbs tested 6 bound directly to CD33 expressing cells while 2 did not.

TABLE 6

Cell Binding of OMNIMOUSE ® derived mAbs to human and cyno expressing cell lines

| mAb | Parental | | | | Human CD33 | | | |
|---|---|---|---|---|---|---|---|---|
| | 60 nM | 6 nM | 0.6 nM | 0 nM | 60 nM | 6 nM | 0.6 nM | 0 nM |
| C33B909 | 253.50 | 206.04 | 169.77 | 119.51 | 176.49 | 170.25 | 154.00 | 191.28 |
| C33B910 | 193.52 | 176.14 | 108.46 | 190.17 | 213.55 | 183.33 | 151.25 | 155.29 |
| C33B911 | 1466.02 | 389.41 | 186.22 | 113.30 | 237954.27 | 100333.48 | 13501.02 | 114.07 |
| C33B912 | 977.91 | 273.07 | 140.62 | 124.53 | 237140.86 | 101295.70 | 15726.96 | 149.54 |
| C33B913 | 174.49 | 118.08 | 123.26 | 129.07 | 518952.00 | 409071.06 | 204694.14 | 127.82 |
| C33B914 | 181.37 | 142.74 | 139.10 | 113.48 | 304350.88 | 315129.56 | 153252.58 | 185.45 |
| C33B915 | 101.28 | 147.65 | 143.51 | 100.00 | 390477.25 | 362902.66 | 138398.56 | 112.22 |
| C33B916 | 416.08 | 145.16 | 115.70 | 91.75 | 447815.47 | 404033.19 | 192941.55 | 167.07 |

| mAb | Cyno CD33 | | | |
|---|---|---|---|---|
| | 60 nM | 6 nM | 0.6 nM | 0 nM |
| C33B909 | 180.33 | 135.33 | 115.73 | 124.03 |
| C33B910 | 202.42 | 135.18 | 116.71 | 175.97 |
| C33B911 | 17036.56 | 7729.14 | 1935.16 | 97.94 |
| C33B912 | 15070.88 | 7271.38 | 1726.03 | 124.69 |
| C33B913 | 40661.90 | 36920.95 | 35224.10 | 106.19 |
| C33B914 | 44964.85 | 33368.26 | 22086.01 | 86.76 |
| C33B915 | 37495.34 | 35692.21 | 36165.59 | 113.92 |
| C33B916 | 41004.43 | 33294.78 | 22790.61 | 104.43 |

The 6 mAbs that bound CD33 on cells were further characterized biophysically via full kinetic analysis to recombinant antigen using the methods described above and summarized in the table below. Of the 6 mAbs tested, 1 bound to human CD33 with a picomolar affinity (C33B912) and subnamolar for cyno CD33, while 1 had very strong affinity for human CD33 but only nanomolar affinity towards cyno CD33 (C33B911). Two more clones were subnanomolar for both human and cyno CD33 (C33B913 and C33B916), but neither affinity was in the range of C33B912.

TABLE 7

Full Kinetics Analysis of OMNIMOUSE ® derived mAbs

| mAb | Human CD33 ECD-HSA | | | Cyno CD33 ECD-HSA | | |
|---|---|---|---|---|---|---|
| | ka (1/Ms) | kd (1/s) | KD (M) | ka (1/Ms) | kd (1/s) | KD (M) |
| C33B911 | 1.10E+06 | 4.14E−05 | 3.78E−11 | 1.15E+06 | 1.15E−03 | 1.00E−09 |
| C33B912 | 1.42E+06 | 4.29E−05 | 3.02E−11 | 1.50E+06 | 6.50E−04 | 4.33E−10 |
| C33B913 | 6.60E+05 | 6.40E−04 | 9.69E−10 | 2.56E+06 | 3.08E−04 | 1.20E−10 |
| C33B914 | 4.44E+05 | 9.80E−03 | 2.21E−08 | 5.29E+05 | 2.33E−04 | 4.40E−10 |
| C33B915 | 2.18E+05 | 9.89E−04 | 4.53E−09 | 3.81E+06 | 8.93E−05 | 2.34E−11 |
| C33B916 | 6.27E+05 | 4.11E−04 | 6.55E−10 | 4.73E+05 | 4.03E−04 | 8.52E−10 |

An epitope binning experiment was performed on the 6 cell binding mAbs derived from OMNIMOUSE® along with several control mAbs previously identified in the earlier OMNIRAT® campaign. The control mAbs were chosen based on their subnanomolar affinity towards human CD33 and the number of distinct epitope bins. The binning software HtTools assigns Epitope Bin numbers on a per experiment basis and therefore having several controls to already defined epitope bins was critical for cross-comparison. The two OMNIMOUSE® derived human CD33 high affinity clones (C33B911 and C33B912) both binned with clones from bin 4 above (bin 4 in this experiment) while the subnanomolar clone (C33B916) binned into 2 here along with C33B836 (bin 1 in the above experiment).

TABLE 8

Epitope Bins of OMNIMOUSE ® anti-CD33 mAbs

| mAb | V region ID | Epitope Bin |
|---|---|---|
| C33B915 | C33F553 | 1 |
| C33B916 | C33F554 | 2 |
| C33B836 | C33F53 | 2 |
| C33B914 | C33F552 | 2 |
| C33B913 | C33F551 | 3 |
| C33B806 | C33F106 | 3 |
| C33B911 | C33F549 | 4 |
| C33B912 | C33F550 | 4 |
| C33B778 | C33F78 | 4 |
| C33B830 | C33F130 | 4 |
| C33B782 | C33F82 | 5 |
| C33B792 | C33F92 | 5 |
| C33B799 | C33F99 | 5 |
| C33B760 | C33F60 | 6 |
| C33B777 | C33F77 | 7 |

CD33 is comprised of 2 IgG domains, the membrane distal V domain and the membrane proximal C2 domain. The SNP rs12459419 can cause the selective alternative splicing of the CD33 pre-mRNA transcript to yield a C2 only form expressed on cells and therefore targeting this domain can provide clinical benefit. To ascertain which of the two domains, the mAbs were capable of binding, an off-rate screen was performed following the protocol above on 6 mAbs with the highest binding capability that covered 4 distinct epitope bins using Human CD33 ECD-HSA, Human CD33 V-HSA and Human CD33 C2-HSA as the binding antigens. As shown in the table below, the two clones previously grouped in bin 4 both bound to the huCD33 C2 domain but not the huCD33 V domain, while the clones in bin 2 and 3 bound the V domain but not the C2 domain. Two clones grouped into bin 5 did not bind either domain, and, therefore, their exact binding location could span the two domains. Three (3) commercially available mAbs were included in this experiment (WM53 (EMD MILLIPORE®; Darmstadt, Germany), P67.7 (BIOLEGEND®, San Diego, Calif.), and LSBio clone 906 (LIFESPAN BIOSCIENCES®, Seattle, Wash.)) and all showed binding to the V domain, but not the C2 domain. Looking at the epitope bins in Tables 5 and 8 in relation to the C2 domain binding data in Table 9, there are a total of 15 mAbs that could potentially bind the C2 domain ranging in affinities from ~25 nM to ~30 μM on the human full length protein.

TABLE 9

Off-rate Domain Binding

| Protein ID | huCD33 ECD-HSA kd (1/s) | huCD33-V-HSA kd (1/s) | huCD33-C2-HSA kd (1/s) | Epitope Bin |
|---|---|---|---|---|
| C33B912 | 1.29E−05 | No/low binding response | 6.68E−05 | 4 |
| C33B778 | 4.72E−05 | No/low binding response | 2.57E−03 | 4 |
| C33B782 | 2.58E−04 | No/low binding response | No/low binding response | 5 |
| C33B792 | 4.27E−04 | No/low binding response | No/low binding response | 5 |
| C33B836 | 5.52E−05 | 3.71E−05 | No/low binding response | 2 |
| C33B806 | 1.36E−03 | 3.18E−03 | No/low binding response | 3 |
| WM53 | 2.37E−03 | 3.78E−02 | No/low binding response | |
| P67.7 | 1.05E−03 | 2.43E−03 | No/low binding response | |
| LSBio clone 906 | 2.45E−03 | 4.34E−02 | No/low binding response | |

To support further in vivo and in vitro studies, select clones (C33B836, C33B782, C33B778, C33B904, C33B806, C33B830, C33B937, C33B792, C33B760, and C33B777) were chosen for scale-up and fab arm exchange to produce bi-specific DUOBODY® molecules with anti-CD3 antibodies. EXPICHO-S™ cells (THERMO FISHER SCIENTIFIC®) were seeded at $1.25 \times 10^5$-$2.25 \times 10^5$ viable cells/mL in EXPICHO™ Expression Medium and cultured in polycarbonate, disposable, sterile, vented, non-baffled Erlenmeyer shake flasks in a 37° C., 7% $CO_2$ shaker incubator (INFORS HT™ MULTITRON PRO™). For routine cell growth in 125 mL-2 L shake flasks, the shake speed was set to 130 rpm for shakers with a 19 mm shaking diameter.

Cells were sub-cultured when the density reached log phase growth at 4×10⁶-6×10⁶ viable cells/mL with a 98-99% viability.

Two days before transfection, EXPICHO-S™ cells were seeded at 1.5×10⁶ viable cells/mL for the required culture volume. On the day of transfection, the viable cell density and percent viability was determined. Cells were transfected at a density of 6×10⁶ viable cells/mL. For optimal transfection, sterile heavy and light chain plasmid DNA at ≥1 mg/mL concentration in TE buffer (10 mM Tris-HCl, 1 mM EDTA, pH 8.0) was used.

EXPICHO-S™ cells were transfected following manufacturer's Max Titer Transfection protocol (THERMO FISHER SCIENTIFIC® Publication Number MAN0014337). All amounts and volumes shown below were per mL of the final transfected culture volume. Briefly, plasmid DNA was diluted with 0.04 mL cold OptiPRO™ medium (THERMO FISHER SCIENTIFIC®) at the following ratio: 0.125 µg Heavy Chain DNA: 0.375 µg Light Chain DNA: 0.5 µg pAdvantage. 6.4 µL of EXPIFECTAMINE™ CHO Transfection Reagent was diluted and mixed gently with 0.04 mL cold OptiPRO™ medium and incubated for 1 min. The diluted EXPIFECTAMINE™ CHO Reagent was added to the diluted DNA, mixed gently and the EXPIFECTAMINE™ CHO/plasmid DNA complexes were incubated at room temperature for 5 minutes. Post-incubation, the complexes were added to the EXPICHO-S™ cells in a shaker flask and incubated overnight in a 37° C., 7% CO₂ shaker incubator.

For the Max Titer protocol, on Day 1 post-transfection, 6 µL EXPIFECTAMINE™ CHO Enhancer and 160 µL EXPICHO-S™ Feed were added and the flask was transferred to a 32° C., 7% CO₂ shaker incubator. On Day 5 post-transfection, 160 µL of EXPICHO-S™ Feed was added for the second time to the flask and returned to the 32° C. incubator with shaking. The culture was harvested on Day 12 post-transfection, centrifuged at 5000 rpm for 15 mins and clarified through a 0.2 nm ACROPAK™ 1500 filter capsule (PALL®).

Expressed antibodies were purified from the clarified supernatants using MABSELECT SURE™ Resin (GE® Healthcare). MABSELECT SURE™ Protein A columns were equilibrated with 1×D-PBS, pH 7.2 prior to loading individual culture supernatants. Unbound proteins were removed by washing extensively with 1×D-PBS, pH 7.2. Bound proteins were eluted with 0.1 M Na-acetate, pH 3.5. Peak fractions were neutralized with 2.5M Tris pH 7.2 and pooled. The neutralized fraction pools were either dialyzed into 1×dPBS for assays and biophysical characterization or utilized for bispecific DUOBODY® assembly.

The protein concentration for each elution pool was determined by measuring absorbance at OD280 nm and calculated using absorbance extinction coefficient based on the amino acid sequence.

Example 3: Fab-Arm Exchange Using Purified Parental mAbs

The formation of the CD33×CD3 bispecific antibodies requires two parental mAbs, one specific for the targeting arm (e.g. CD33) and one specific for the effector arm (e.g. CD3). CD33 mAbs were recombined with a high affinity (CD3B219) or low affinity CD3 arm (CD3B376) arms. These parental mAbs are in the IgG4 PAA format (Labrijn et al, 2013) where the targeting parent (CD33) contains the K409R mutation (native amino acid for IgG4), while the killing parent (CD3) contains the F405L mutation and R409K. The monospecific anti-CD3 antibody was expressed as IgG4, having Fc substitutions S228P, F234A, L235A, F405L, and R409K (CD3 arm) (numbering according to EU index) in their Fc regions. The monospecific antibodies were expressed and purified as described above. Post purification the parental CD33 antibodies were mixed with the desired parental CD3 antibody under reducing conditions in 75 mM cysteamine-HCl and incubated at 31° C. for 5 hours. The recombination reactions were based on molar ratios, where a set amount of CD33 antibody (e.g., 10 mg, or ~74.6 nanomoles) was combined with CD3 antibody (e.g., ~67.8 nanomoles), where the CD33 antibody was added in a 6% excess of the CD3 antibody. The concentrations of the CD33 antibody stocks varied from 0.8 to 6 mg/mL, and the volumes of the recombination reactions varied for each pairing. The recombination reactions were subsequently dialyzed overnight against PBS to remove the reductant. The CD33×CD3 bispecific antibody reactions were performed with an excess of the CD33 antibody (ratio) to minimize the amount of unreacted CD3 parental antibody remaining after recombination.

The final CD33×CD3 bispecific antibodies produced, along with the parental mAbs (i.e. CD33, CD3, or Null) used in the recombination reactions are listed in Table 10.

Selected CD33 hits were also paired with a non-killing arm (Null) to create negative controls for testing purposes. For control bispecific antibodies, B2M1, an RSV antibody in the IgG4 PAA format was generated, purified and, combined with either the CD3 arms CD3B219 and CD3B376-F405L, R409K to generate CD3B288 (CD3×Null) and CD3B510 (CD3B376×Null) or CD33 arms, C33B836, C33B806, C33B782, C33B792, C33B760, C33B830, C33B799, C33B778, C33B777 to generate C33B941, C33B943, C33B946, C33B945, C33B949, C33B942, C33B944, C33B947, C33B948, respectively (CD33×Null).

TABLE 10

CD33 x CD3 bispecific antibodies

| Bispec Ab | Parental | HC Pep ID | HC Pep SEQ ID | HC Nuc SEQ ID | LC Pep ID | LC Pep SEQ ID | LC Nuc SEQ ID |
|---|---|---|---|---|---|---|---|
| C3CB7 | C33B836 | C33H80 | 52 | 94 | C33L73 | 136 | 178 |
|  | CD3B219 | CD3H141 | 244 | 247 | CD3L66 | 250 | 253 |
| C3CB5 | C33B830 | C33H84 | 51 | 93 | C33L66 | 135 | 177 |
|  | CD3B219 | CD3H141 | 244 | 147 | CD3L66 | 250 | 253 |
| C3CB4 | C33B806 | C33H69 | 50 | 92 | C4LL152 | 134 | 176 |
|  | CD3B219 | CD3H141 | 244 | 247 | CD3L66 | 250 | 253 |
| C3CB16 | C33B799 | C33H98 | 49 | 91 | C33L69 | 133 | 175 |
|  | CD3B219 | CD3H141 | 244 | 247 | CD3L66 | 250 | 253 |
| C3CB14 | C33B792 | C33H87 | 48 | 90 | C33L35 | 132 | 174 |
|  | CD3B219 | CD3H141 | 244 | 247 | CD3L66 | 250 | 253 |

TABLE 10-continued

CD33 x CD3 bispecific antibodies

| Bispec Ab | Parental | HC Pep ID | HC Pep SEQ ID | HC Nuc SEQ ID | LC Pep ID | LC Pep SEQ ID | LC Nuc SEQ ID |
|---|---|---|---|---|---|---|---|
| C3CB12 | C33B782 | C33H72 | 47 | 89 | C33L40 | 131 | 173 |
| | CD3B219 | CD3H141 | 244 | 247 | CD3L66 | 250 | 253 |
| C3CB11 | C33B778 | C33H66 | 46 | 88 | C33L60 | 130 | 172 |
| | CD3B219 | CD3H141 | 244 | 247 | CD3L66 | 250 | 253 |
| C3CB10 | C33B777 | C33H65 | 45 | 86 | C33L47 | 129 | 171 |
| | CD3B219 | CD3H141 | 244 | 247 | CD3L66 | 250 | 253 |
| C3CB8 | C33B760 | C33H45 | 44 | 85 | C33L11 | 128 | 170 |
| | CD3B219 | CD3H141 | 244 | 247 | CD3L66 | 250 | 253 |
| C3CB97 | C33B836 | C33H80 | 52 | 94 | C33L73 | 136 | 178 |
| | CD3B376 | CD3H219 | 245 | 248 | CD3L150 | 251 | 254 |
| C3CB98 | C33B830 | C33H84 | 51 | 93 | C33L66 | 135 | 177 |
| | CD3B376 | CD3H219 | 245 | 248 | CD3L150 | 251 | 254 |
| C3CB99 | C33B806 | C33H69 | 50 | 92 | C4LL152 | 134 | 176 |
| | CD3B376 | CD3H219 | 245 | 248 | CD3L150 | 251 | 254 |
| C3CB100 | C33B799 | C33H98 | 49 | 91 | C33L69 | 133 | 175 |
| | CD3B376 | CD3H219 | 245 | 248 | CD3L150 | 251 | 254 |
| C3CB101 | C33B792 | C33H87 | 48 | 90 | C33L35 | 132 | 174 |
| | CD3B376 | CD3H219 | 245 | 248 | CD3L150 | 251 | 254 |
| C3CB102 | C33B782 | C33H72 | 47 | 89 | C33L40 | 131 | 173 |
| | CD3B376 | CD3H219 | 245 | 248 | CD3L150 | 251 | 254 |
| C3CB103 | C33B778 | C33H66 | 46 | 88 | C33L60 | 130 | 172 |
| | CD3B376 | CD3H219 | 245 | 248 | CD3L150 | 251 | 254 |
| C3CB104 | C33B777 | C33H65 | 45 | 86 | C33L47 | 129 | 171 |
| | CD3B376 | CD3H219 | 245 | 248 | CD3L150 | 251 | 254 |
| C3CB105 | C33B760 | C33H45 | 44 | 85 | C33L11 | 128 | 170 |
| | CD3B376 | CD3H219 | 245 | 248 | CD3L150 | 251 | 254 |
| C33B941 | C33B836 | C33H80 | 52 | 94 | C33L73 | 136 | 178 |
| | B23B49 | B23H1 | 246 | 249 | B23L3 | 252 | 255 |
| C33B942 | C33B830 | C33H84 | 51 | 93 | C33L66 | 135 | 177 |
| | B23B49 | B23H1 | 246 | 249 | B23L3 | 252 | 255 |
| C33B943 | C33B806 | C33H69 | 50 | 92 | C4LL152 | 134 | 176 |
| | B23B49 | B23H1 | 246 | 249 | B23L3 | 252 | 255 |
| C33B944 | C33B799 | C33H98 | 49 | 91 | C33L69 | 133 | 175 |
| | B23B49 | B23H1 | 246 | 249 | B23L3 | 252 | 255 |
| C33B945 | C33B792 | C33H87 | 48 | 90 | C33L35 | 132 | 174 |
| | B23B49 | B23H1 | 246 | 249 | B23L3 | 252 | 255 |
| C33B946 | C33B782 | C33H72 | 47 | 89 | C33L40 | 131 | 173 |
| | B23B49 | B23H1 | 246 | 249 | B23L3 | 252 | 255 |
| C33B947 | C33B778 | C33H66 | 46 | 88 | C33L60 | 130 | 172 |
| | B23B49 | B23H1 | 246 | 249 | B23L3 | 252 | 255 |
| C33B948 | C33B777 | C33H65 | 45 | 86 | C33L47 | 129 | 171 |
| | B23B49 | B23H1 | 246 | 249 | B23L3 | 252 | 255 |
| C33B949 | C33B760 | C33H45 | 44 | 85 | C33L11 | 128 | 170 |
| | B23B49 | B23H1 | 246 | 249 | B23L3 | 252 | 255 |
| CD3B288 | B23B39 | B23H1 | 246 | 249 | B23L3 | 252 | 255 |
| | CD3B219 | CD3H141 | 244 | 247 | CD3L66 | 250 | 253 |
| CD3B510 | B23B39 | B23H1 | 246 | 249 | B23L3 | 252 | 255 |
| | CD3B376 | CD3H219 | 245 | 248 | CD3L150 | 251 | 254 |
| C3CB87 | C33B903 | C33H251 | 182 | 198 | C33L117 | 214 | 230 |
| | CD3B219 | CD3H141 | 244 | 247 | CD3L66 | 250 | 253 |
| C3CB88 | C33B904 | C33H252 | 183 | 199 | C33L118 | 215 | 231 |
| | CD3B219 | CD3H141 | 244 | 247 | CD3L66 | 250 | 253 |
| C3CB89 | C33B905 | C33H253 | 184 | 200 | C33L119 | 216 | 232 |
| | CD3B219 | CD3H141 | 244 | 247 | CD3L66 | 250 | 253 |
| C3CB90 | C33B907 | C33H255 | 186 | 202 | C33L121 | 218 | 234 |
| | CD3B219 | CD3H141 | 244 | 247 | CD3L66 | 250 | 253 |
| C3CB91 | C33B908 | C33H256 | 187 | 203 | C33L122 | 219 | 235 |
| | CD3B219 | CD3H141 | 244 | 247 | CD3L66 | 250 | 253 |
| C3CB189 | C33B904 | C33H252 | 183 | 199 | C33L118 | 215 | 231 |
| | CD3B376 | CD3H219 | 245 | 248 | CD3L150 | 251 | 254 |

Pep: Peptide;
Nuc: Nucleotide;
SEQ ID: SEQ ID NO

Figure 1A:
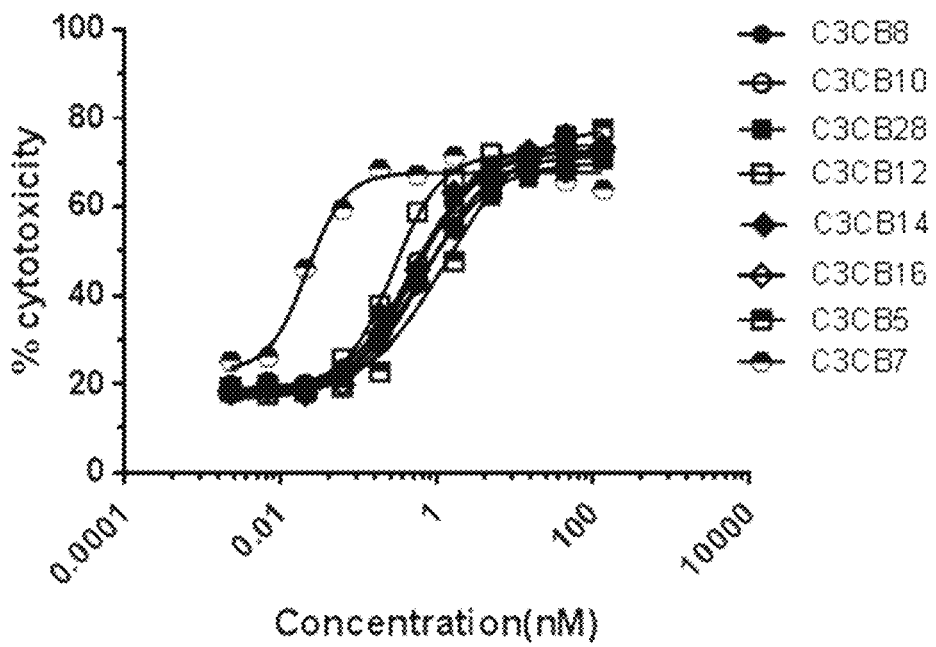
FIGS. 1A-1B show CD33×CD3 T-cell mediated cytotoxicity assays. CD33×CD3 bispecific antibodies using anti-CD3 arm CD3B219 were incubated with human pan T cells and a CD33$^+$ AML cell line. After 48 hr at 37° C., 5% $CO_2$, total tumor cell cytotoxicity was measured by flow cytometry.
Figure 1B:
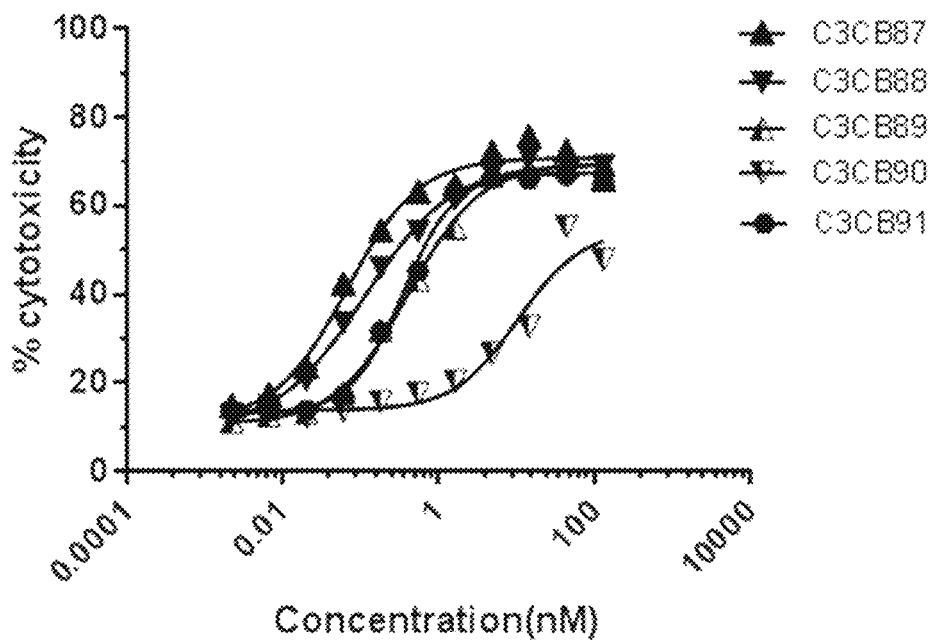

Example 4: In Vitro T Cell Mediated Cytotoxicity Assays with CD33×CD3 Bispecific Antibodies In vitro T cell mediated cytotoxicity assays were performed to assess whether CD33 hits paired with CD3 arm (CD3B219) mediate killing of CD33 expressing AML cell line OCI-AML5. Briefly, effector cells (pan T cells purchased from BIOLOGICAL SPECIALTY®) were harvested, counted, washed, and resuspended to $1\times10^6$ cells/ml in RPMI (INVITROGEN®) with 10% FBS (INVITROGEN®) cell media. Target cells (MOLM13) were labeled with CFSE (INVITROGEN®) and resuspended to $2\times10^5$ cells/mL in RPMI with 10% FBS. Effectors and CFSE-labeled target cells were mixed at E:T=5:1 in sterile 96-well round bottom plates. 10 μL of Fc block (REOPRO® Fc fragment) along with a 5 μL aliquot of bispecific antibody was added to each well containing various concentrations. Cultures were incubated at 37° C. for 48 hours under 5% $CO_2$. After 48 hr, the LIVE/DEAD® Fixable Near-IR Dead Cell Stain buffer (LIFE TECHNOLOGIES™) was added to samples and cultures were incubated for 20 min in the dark at RT, washed, and resuspended in 100-200 µL FACs buffer. The drug-induced cytotoxicity was determined using CANTO™ II flow cytometer (BD® Biosciences; Franklin Lakes, N.J.) and analyzed with FLOWJO™ Software or Dive software (BD® Biosciences). The population of interest is the double positive CFSE+/live/dead+ cells. As shown in FIG. 1, all of the CD33×CD3 multispecific antibodies, induced T cell redirected cell cytotoxicity of $CD33^+$ MOLM-13 cells at 48 hrs. Table 11 summarize the $EC_{50}$ values generated with the CD33×CD3 multispecific antibodies. The top 4 antibodies, C3CB10, C3CB12, C3CB7 and C3CB88 were taken forward for further characterization.

dose-dependent reduction of total cytotoxicity that correlated with T cell activation after 48 hours. Null arm control antibodies (Null×CD3B219 and null×CD3B376) failed to show tumor cell cytotoxicity or T cell activation. This result also demonstrated that the CD33×CD3 bispecific antibodies work in an autologous setting. These results are representative of 4 other AML donor samples (data not shown). The Table 12 summarize the $EC_{50}$ values generated with the CD33×CD3 multispecific antibodies. As seen from the $EC_{50}$ values, C33B904 paired with either CD3 arm (C3CB88, C3CB189) as well C33B836 paired with either CD3 arm (C3CB7, C3CB97) were the most potent and efficacious antibodies. These 4 antibodies were thus the focus of further characterization.

TABLE 11

CD33 × CD3 T-cell mediated cytotoxicity assays. Summary of $EC_{50}$ values for 13 CD33×CD3 bispecific antibodies

| | Leads | | | | | | | |
|---|---|---|---|---|---|---|---|---|
| | C3CB8 | C3CB10 | C3CB28 | C3CB12 | C3CB14 | C3CB16 | C3CB5 | C3CB7 |
| Cytotoxicity $EC_{50}$ (nM) | 0.513 | 0.4728 | 0.6041 | 0.2677 | 0.538 | 0.6669 | 1.262 | 0.02129 |

| | Leads | | | | |
|---|---|---|---|---|---|
| | C3CB87 | C3CB88 | C3CB89 | C3CB90 | C3CB91 |
| Cytotoxicity $EC_{50}$ (nM) | 0.067 | 0.11 | 0.41 | 10.56 | 0.35 |

Figure 2A:
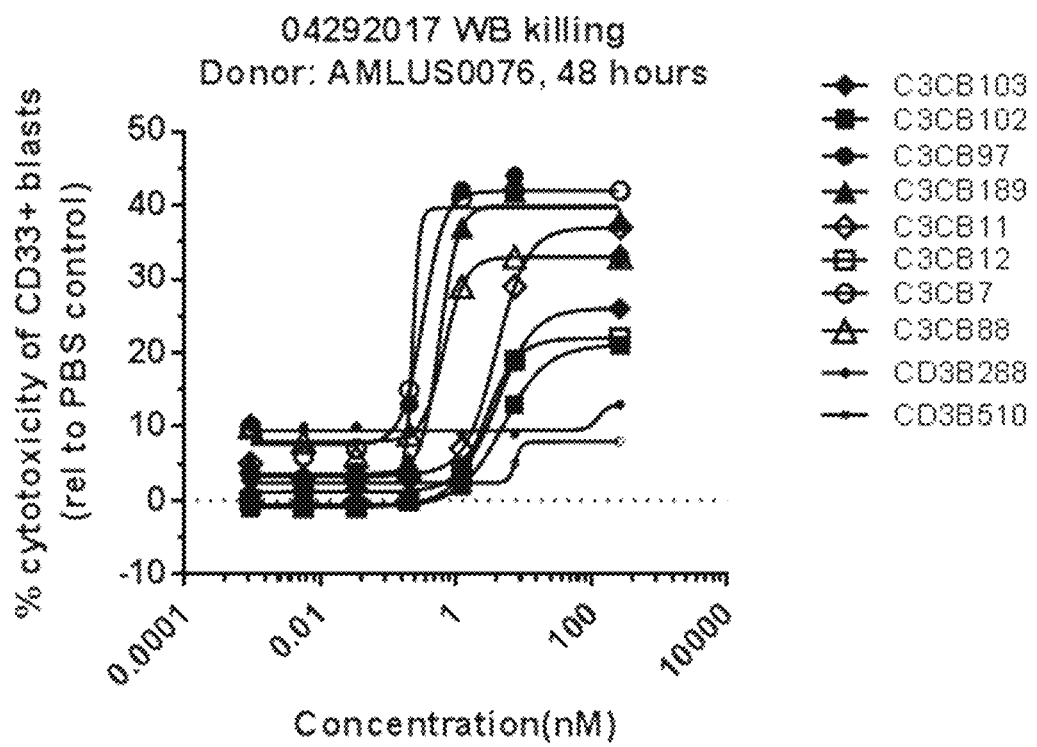
FIGS. 2A-2B show ex vivo assessment of CD33×CD3 bispecific antibodies using anti-CD3 arm CD3B219 and CD3B376 cytotoxicity of blasts and T cell activation in fresh AML patient whole blood.
Figure 2B:
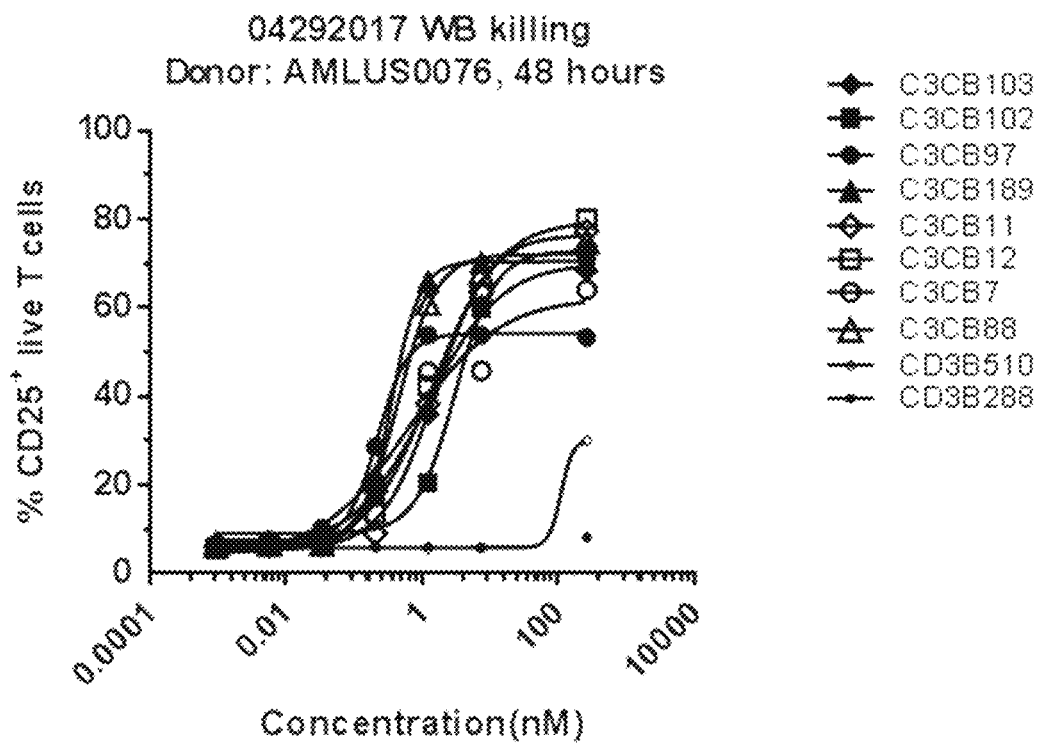

Example 5: Ex Vivo CD33×CD3 Mediated Reduction of AML Blasts and T Cell Activation in an AML Primary Sample To further assess the cytotoxicity potential of CD33×CD3 bispecific antibodies, an ex vivo cytotoxicity assay was performed using AML patient whole blood using the top four antibodies (FIG. 2). In this assay, various bispecific antibodies (CD33 antibodies paired with either CD3 arm CD3B219 and CD3B376) were added to diluted whole blood from AML patients for a period of 48 hours without providing additional T-cells, since this assay relies on the presence of autologous T-cells in the patient's blood. At 48 hours, the samples were stained with CD3 PerCPCy5.5, CD25 PE, CD33 FITC and CD38 APC (all antibodies were purchased from BIOLEGEND®; San Diego, Calif.). The samples were then washed at least 3 times in 1× Lyse RBC Lysis Buffer (EBIOSCIENCE®). The samples were then stained with the LIVE/DEAD® Fixable Near-IR Dead Cell Stain buffer (LIFE TECHNOLOGIES™). The extent of tumor cytotoxicity was determined by first quantifying the live $CD33^+$ cells in the fraction of AML patient cancer cells (defined as $CD3^-CD38^+$ cells) in the presence of the bispecific antibodies. Cytotoxicity was calculated as a percentage relative to PBS/untreated control using the following equation: (% $CD33^+$ in PBS/untreated control–% $CD33^+$ in treated sample)/(% $CD33^+$ in PBS/untreated control). T cell activation was calculated as a percentage of $CD25^+$ events in $CD3^+$ fraction.

As shown in FIG. 2, all CD33 lead antibodies paired with either CD3 arm (CD3B376 and CD3B219) promoted a

TABLE 12

CD33 × CD3 T-cell mediated ex vivo cytotoxicity assays. Summary of the $EC_{50}$ values for 8 CD33 × CD3 bispecific antibodies

| Bispecifc Ab ID | Primary AML Cell Killing $EC_{50}$ (nM) |
|---|---|
| C3CB11 | 3.958 |
| C3CB12 | 2.635 |
| C3CB7 | 0.3315 |
| C3CB88 | 0.6722 |
| C3CB103 | 4.186 |
| C3CB102 | 4.973 |
| C3CB97 | ~0.2316 |
| C3CB189 | 0.5782 |

Figure 3A:
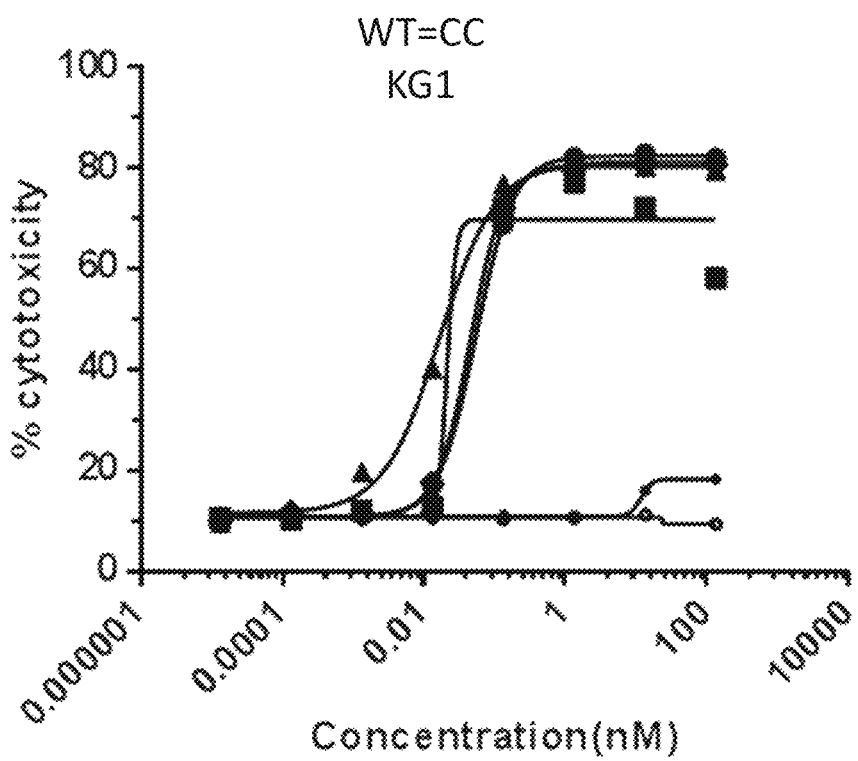
FIGS. 3A-3C show CD33×CD3 T-cell mediated cytotoxicity assays. CD33×CD3 bispecific antibodies using anti-CD3 arm CD3B219 and anti-CD3B376 were incubated with human pan T cells and AML cell lines that are either wildtype (KG1, FIG. 3A), heterozygous (SH2, FIG. 3B) or homozygous (OCIAML3, FIG. 3C) for the CD33 SNP rs12459419 mutation. After 48 hr at 37° C., 5% $CO_2$, total tumor cell cytotoxicity was measured by flow cytometry.
Figure 3B:
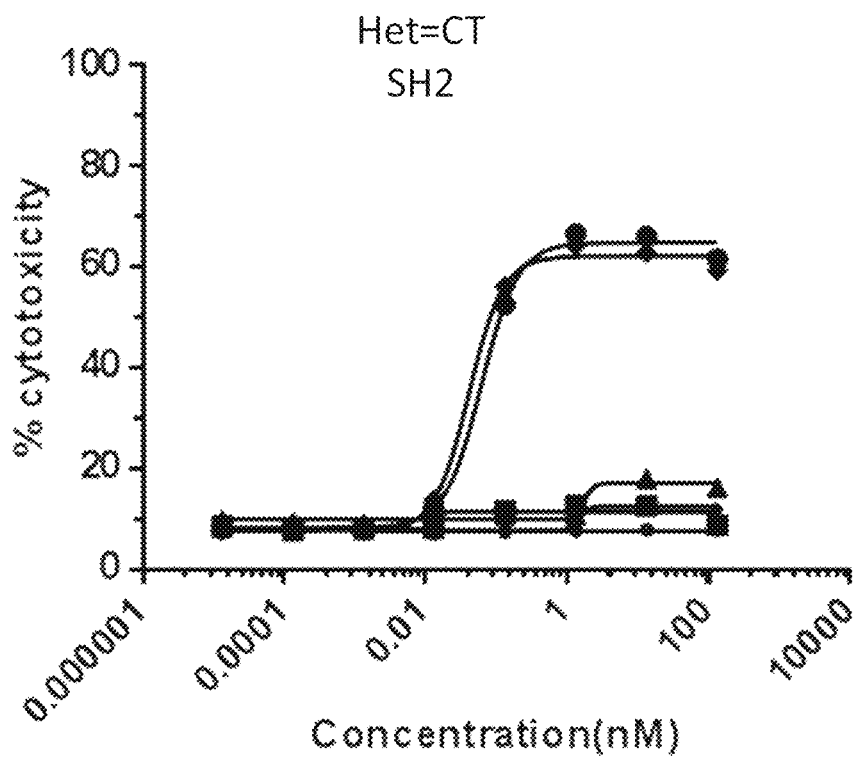
Figure 3C:
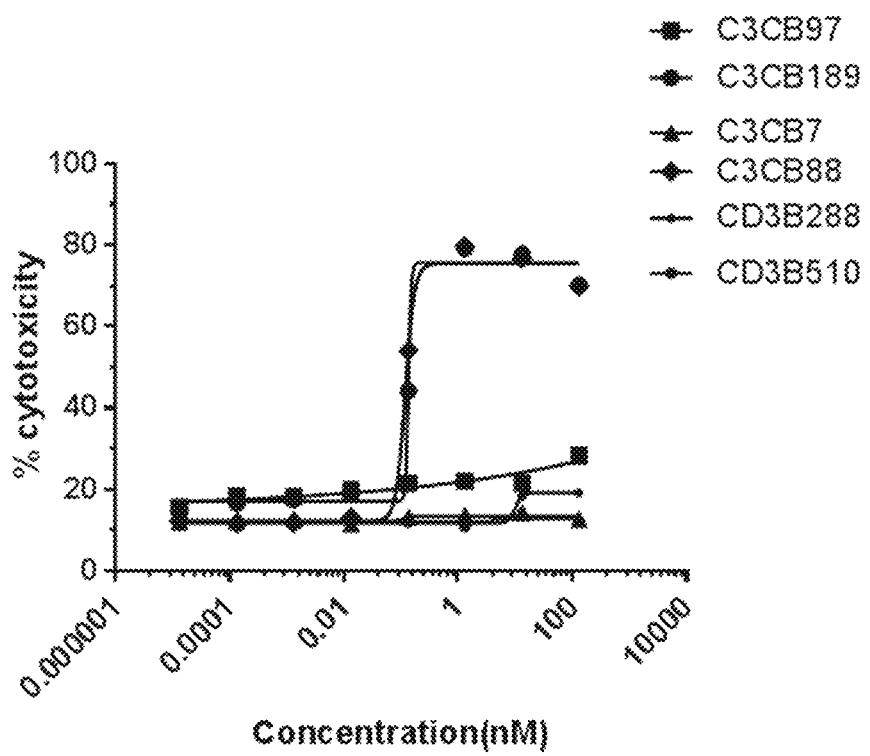

Example 6: Demonstration that the CD33×CD3 Bispecific Antibodies Binds to the C2 Domains of CD33 and Induces Cytotoxicity of CD33 Single Nucleotide Polymorphism (SNP) Expressing Cell Lines In Vitro T Cell Mediated Cytotoxicity Assays with CD33×CD3 Bispecific Antibodies Recent studies showed that a single nucleotide polymorphism (SNP) rs12459419 was present in ~50% of the AML population and leads to skipping of exon 2 of CD33 which results in the deletion of the V domain of CD33. This study also showed that MYLOTARG™ which binds to the V domain of CD33, had no efficacy in patients that express the SNP, and, therefore, reduced risk of relapse and improved survival in ~50% of the AML population (Lamba et al 2017, JCO, CD33 Splicing Polymorphism Determines Gemtuzumab Ozogamicin Response in De Novo Acute Myeloid Leukemia: Report From Randomized Phase III Children's Oncology Group Trial AAML0531). Given the data with MYLOTARG™ in the above mentioned study, in vitro T cell mediated cytotoxicity assays were performed to assess whether CD33 hits (V binding C33B836 vs C2 binding C33B904) paired with CD3 arms (CD3B219 or CD3B376) mediate killing of SNP rs12459419 expressing cell lines. Briefly, effector cells (pan T cells purchased from BIOLOGICAL SPECIALTY®) were harvested, counted, washed, and resuspended to $1\times10^6$ cells/ml in RPMI (INVITROGEN®) with 10% FBS (INVTTROGEN®) cell media. Target cells (KG1, SH2 and OCIAML3) were labeled with CFSE (INVITROGEN®) and resuspended to $2\times10^5$ cells/mL in RPMI with 10% FBS. KG1, SH2 and OCIAML3 were chosen to represent wildtype, heterozygous and homozygous for the CD33 SNP rs12459419 mutation, respectively. Effectors and CFSE-labeled target cells were mixed at effector:target ratio (E:T)=5:1 in sterile 96-well round bottom plates. 10 µl of Fc block (REOPRO® Fc fragment) along with 5 µL aliquot of bispecific antibody was added to each well containing various concentrations. Cultures were incubated at 37° C. for 48 hours under 5% $CO_2$. After 48 hrs, the LIVE/DEAD® Fixable Near-IR Dead Cell Stain buffer (LIFE TECHNOLOGIES™) was added to samples and cultures were incubated for 20 min in the dark at RT, washed, and resuspended in 100-200 µL FACs buffer. The drug-induced cytotoxicity was determined using CANTO™ II flow cytometer (BD® Biosciences) and analyzed with FLOWJO™ Software or Dive software (BD® Biosciences). The population of interest is the double positive CFSE+/live/dead+ cells. As shown in FIG. 3, unlike the null arm controls (null×CD3B219 and null×CD3B376), V binding and C2 binding CD33×CD3 multispecific antibodies induced T cell redirected cell cytotoxicity of CD33+ WT for SNP rs12459419 mutation cell line KG1 at 48 hrs. In contrast, unlike V binder C33B836 (C3CB97, C3CB7), only the C2 binding C33B904 paired bispecific antibodies (C3CB189, C3CB88) mediated cytotoxicity of SH2 and OCIAML3 cell lines that were heterozygous or homozygous for the rs12459419 SNP mutations, respectively. For this reason, C33B904 paired bispecific antibodies (C3CB189, C3CB88) were taken forward for further analysis and characterization. Collectively, these data suggest that CD33 C2 binding bispecific antibodies such as C33B904 paired bispecific antibodies have the potential to show efficacy in a broader group of AML patients than V binding competitor anti-CD33 antibodies.

Figure 4A:
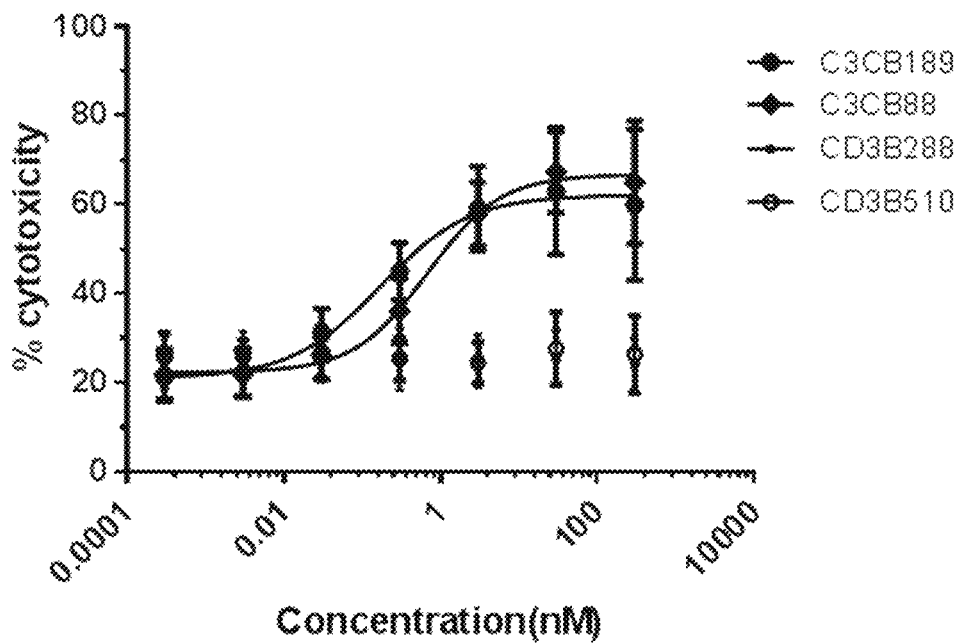
FIGS. 4A-4B show ex vivo assessment of C33B904 antibodies paired with either CD3B219 or CD3B376 on the cytotoxicity of MOLM-13 cells exogenously added to normal healthy human whole blood (N=6 donors): Percent of cytotoxicity of MOLM-13 cells (FIG. 4A) and CD33$^+$CD14$^+$ monocytes (FIG. 4B) using CD33×CD3 bispecifics and respective null×CD3 controls at 48 hrs.
Figure 4B:
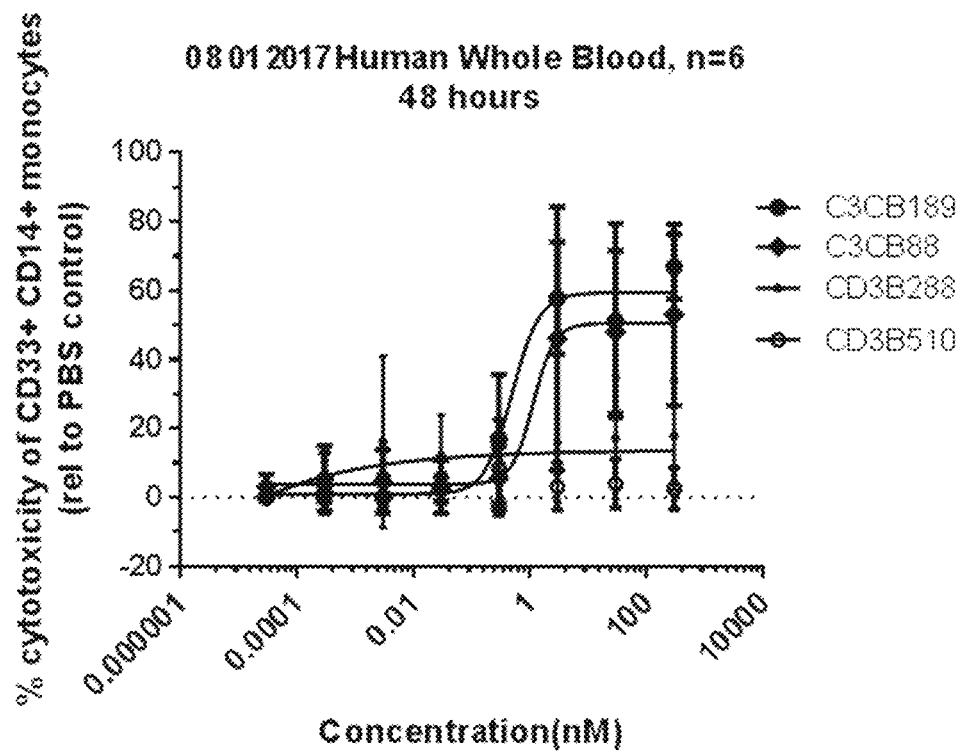

Example 7: Ex Vivo CD33×CD3 Mediated Reduction of Spiked in MOLM-13 and Monocytes in an Ex Vivo Whole Blood MOLM-13 Cytotoxicity Assay To assess the cytotoxicity potential of CD33×CD3 bispecific antibodies at eliminating spiked in MOLM-13 cells and normal human monocytes, an ex vivo cytotoxicity assay using normal healthy human whole blood with exogenously added CD33+ AML cell line MOLM-13 was utilized. Similar to the above experiment, various bispecific antibodies (CD33 antibodies paired with either CD3 arm CD3B219 and CD3B376) were added to diluted whole blood from 6 different normal human donors for a period of 48 hr without providing additional T-cells, since this assay relies on the presence of autologous T-cells in the donor's blood. Prior to dilution, the concentration of T cells in the blood of each donor was enumerated. The blood was then diluted with CFSE ( ) labeled MOLM-13 cells, such that effector:target ratio (E:T) is 1:5 to mimic the effector: target ratio in AML patient samples. At 48 hs, the samples were stained with CD3 PerCPCy5.5, CD25 PE, CD33 FITC and CD14 Pacific Blue (all antibodies were purchased from BIOLEGEND®). The samples were then washed at least 3 times in 1× Lyse RBC Lysis Buffer (EBIOSCIENCE®). The samples were then stained with the LIVE/DEAD® Fixable Near-IR Dead Cell Stain buffer (LIFE TECHNOLOGIES™). The extent of tumor cytotoxicity was determined by first quantifying the live CD33+ cells in the fraction of CD14+ monocytes in the presence of the bispecific antibodies. Cytotoxicity of MOLM-13 cells was determined by enumerating the percentage of dead CFSE+ cells. Cytotoxicity of monocytes was calculated as a percentage relative to PBS/untreated control using the following equation: (% CD33+ CD14+ in PBS/untreated control−% CD33+ CD14+ in treated sample)/(% CD33+ CD14+ in PBS/untreated control). The data in FIG. 4 indicate that both CD33×CD3 bispecific antibodies (same CD33 lead C33B904 paired with either CD3 arm, CD3B376 and CD3B219) specifically induce cell cytotoxicity of MOLM-13 cells and CD33+ monocytes at 48 hr. The null arm controls were used as negative bispecific antibody controls. The null arm control showed little-to-no cytotoxicity activity of the MOLM-13 and CD33+ monocytes. These data show the average values of 6 different normal donors. The average $EC_{50}$ values for cytotoxicity of MOLM-13 and CD14+ monocytes are shown in Table 13.

TABLE 13

CD33 × CD3 T-cell mediated ex vivo cytotoxicity assays. Summary of $EC_{50}$ values for 2 CD33 × CD3 bispecific antibodies.

| Bispecific Ab ID | MOLM13 Killing $EC_{50}$ (nM) | CD33+ CD14+ Killing $EC_{50}$ (nM) |
|---|---|---|
| C3CB189 | 0.1677 | 1.156 |
| C3CB88 | 0.671 | 0.506 |

Figure 5A:
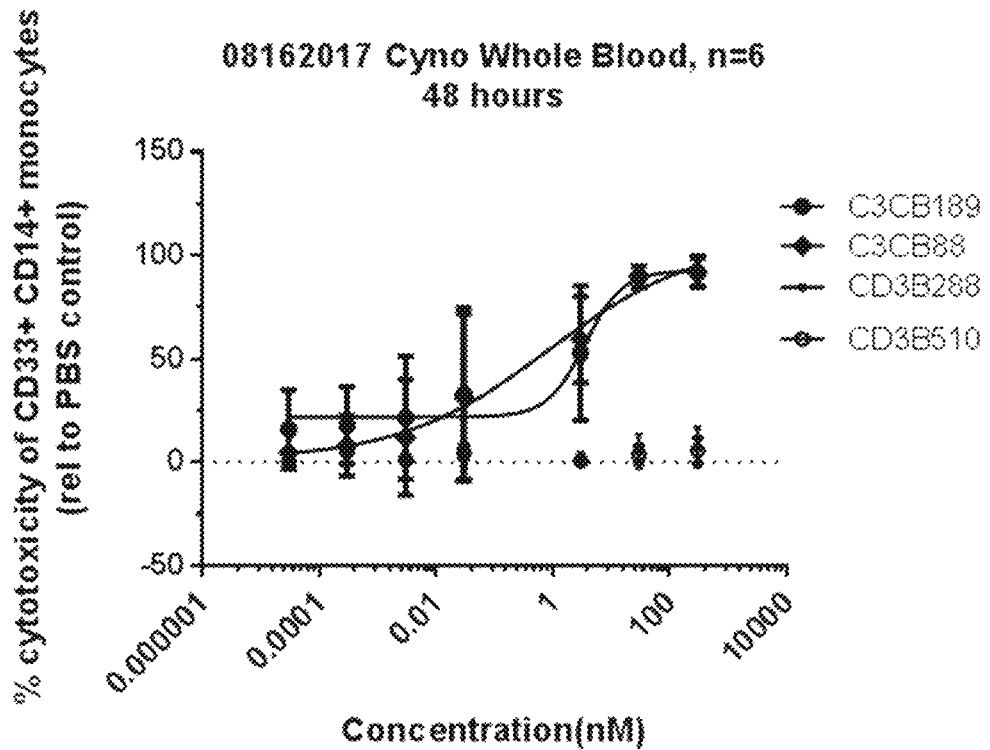
FIGS. 5A-5B show ex vivo assessment of CD33×CD3 bispecific antibodies using anti-CD3 arm CD3B219 and CD3B376 on the cytotoxicity of monocytes and T cell activation in fresh whole blood from six normal cynomolgus monkey donors.
Figure 5B:
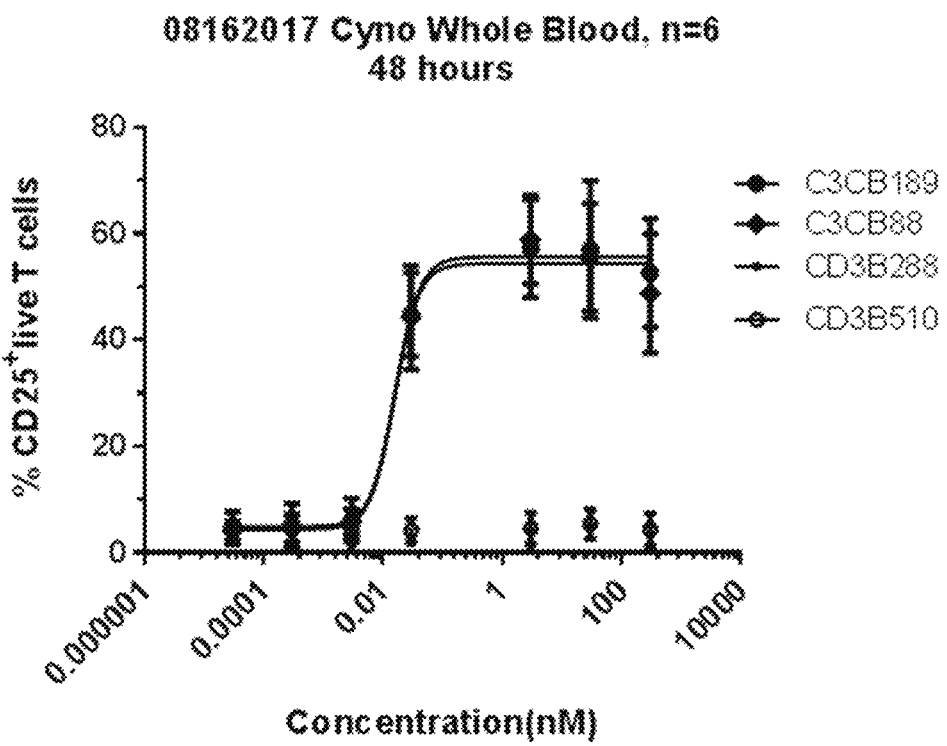

Example 8: Demonstration of Species Cross-Reactivity of CD33×CD3 Bispecific Antibodies to Cynomolgus Monkey Ex Vivo CD33×CD3 Mediated Reduction of Monocytes in an Ex Vivo Cytotoxicity Assay with Cynomolgus Whole Blood To demonstrate functional cross-reactivity and to assess the cytotoxicity potential of CD33×CD3 bispecific antibodies at eliminating normal cynomolgus monocytes, an ex vivo cytotoxicity assay using healthy cynomolgus whole blood was utilized. Similar to the above experiment, various bispecific antibodies (CD33 antibodies paired with either CD3 arm CD3B219 and CD3B376) were added to diluted whole blood from 6 different normal cynomolgus monkey donors for a period of 48 hr without providing additional T-cells, since this assay relies on the presence of autologous T-cells in the donor's blood. At 48 hrs, the samples were stained with CD3 PerCPCy5.5, CD25 PE, CD33 FITC and CD14 Pacific Blue (all antibodies were purchased from BIOLEGEND® except for the CD33 antibody which was purchased from Miltenyi; Bergisch Gladbach, Germany). The samples were then washed at least 3 times in 1× Lyse RBC Lysis Buffer (EBIOSCIENCE®) prior to staining with the LIVE/DEAD® Fixable Near-IR Dead Cell Stain buffer (LIFE TECHNOLOGIES™). The extent of monocyte cytotoxicity was determined by first quantifying the live CD33+ cells in the fraction of CD4+ monocytes in the presence of the bispecific antibodies. Cytotoxicity was calculated as a percentage relative to PBS/untreated control using the following equation: (% CD33+CD14+ in PBS/untreated control−% CD33+ CD4+ in treated sample)/(% CD33+ CD14+ in PBS/untreated control). T cell activation was calculated as a percentage of CD25+ events in CD3+ fraction. The data in FIG. 5 indicated that both CD33×CD3 bispecific antibodies (same CD33 lead C33B904 paired with either CD3 arm, CD3B376 and CD3B219) specifically induced cell cytotoxicity of CD33+ monocytes as well as T cell activation at 48 hr. The null arm controls were used as negative bispecific antibody controls and showed little-to-no cytotoxicity or T cell activity. Table 14 show the average values of 6 different cynomolgus donors.

TABLE 14

CD33 × CD3 T-cell mediated ex vivo cytotoxicity assays. Summary of the $EC_{50}$ values for 2 CD33 × CD3 bispecific antibodies.

| Protein AA ID | CD33+ CD14+ Killing $EC_{50}$ (nM) | T cell activation $EC_{50}$ (nM) |
|---|---|---|
| C3CB189 | 3.60 | 0.02 |
| C3CB88 | 0.89 | 0.02 |

Example 9: Efficacy of C3CB189 and C3CB88 in MOLM-13 Human AML Xenografts in T Cell Humanized NSG Mice Efficacy of C3CB189 and C3CB88 was evaluated in established luciferase-transfected disseminated MOLM-13 human acute myeloid leukemia (AML) xenografts in female NOD.Cg-Prkdc$^{scid}$ Il2rg$^{tm1Wjl}$/SzJ (NSG) mice humanized with 20 million T cells. Animals were randomized into n=10/group by live bioluminescence imaging (BLI) on day 5 post-i.v. tumor implantation. C3CB189 and C3CB88 at 0.005, 0.05 and 0.5 mg/kg or Null×CD3 antibody control at 0.5 mg/kg were dosed i.p. every 3-4 days for 6 weeks.

Figure 6:
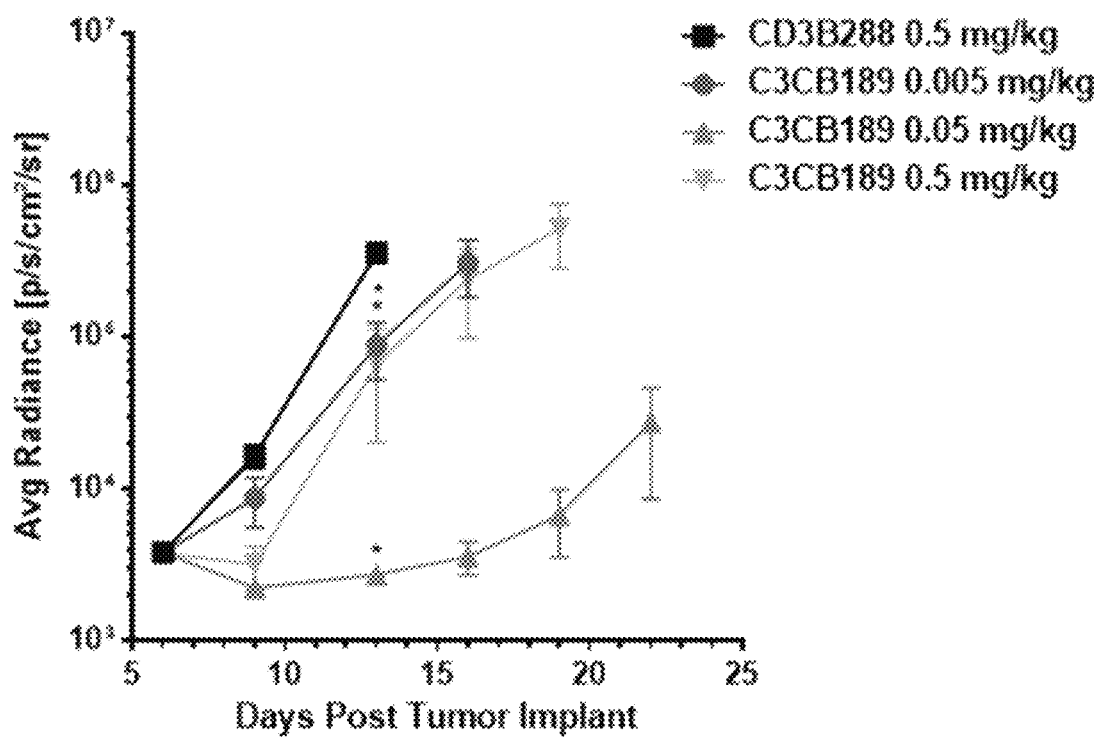
FIG. 6 shows anti-tumor efficacy of C3CB189 in MOLM-13 human AML xenografts in T cell humanized NSG mice.

On day 13 post-tumor implantation, when at least eight animals remained per group, tumor growth inhibition (% TGI) as determined by bioluminescence was calculated. Statistically significant tumor growth inhibition was observed with C3CB189 (FIG. 6) and C3CB88 (FIG. 8) at all concentrations, as compared to Null×CD3 control. C3CB189 at 0.005, 0.05, and 0.5 mg/kg elicited tumor growth inhibition of 76%, 100% and 82%, respectively, and C3CB88 at 0.005, 0.05, and 0.5 mg/kg elicited tumor growth inhibition of 100%, 100% and 91%, respectively, as compared to Null×CD3 treated controls.

Treatment with C3CB189 and C3CB88 resulted in reduced tumor burden and increased life span (ILS) greater than the 16-day median survival of the Null×CD3 control group. Animals treated with C3CB189 had a median survival of 19-27.5 days (FIG. 7) and animals treated with C3CB88 had a median survival of 26-28.5 (FIG. 9) days across doses. C3CB189 at 0.005, 0.05, and 0.5 mg/kg resulted in an increased life span of 19%, 72% and 50%, respectively, and C3CB88 resulted in an increased life span of 63%, 78% and 72%, respectively, as compared to the control group.

Example 10: Demonstration of Internalization of CD33 Antibodies in an In Vitro Protein a Drug Conjugate Cell Viability Assay An in vitro cell viability assay using pre-loaded protein A drug conjugate, A-MMAF, was performed to detect internalization of ligand-bound target antibodies. This cell-based functional assay was performed with a panel of anti-CD33 antibodies, C33B782, C33B806, C33B836, C33B904, C33B937, and an isotype control antibody CNTO9412 in an AML cell line MOLM13. The target antibody alone was tested as a control in this assay to differentiate cytotoxicity due to antibody internalization and cytotoxicity due to the activity of the test antibodies on their own. FIG. 10 shows the cytotoxicity with Protein A-MMAF-bound antibodies in MOLM13 after 72 hours of incubation at 37° C., 5% $CO_2$. Concentration-dependent cytotoxicity was observed with all five CD33 antibodies in MOLM13 cells, suggesting internalization of all five antibodies in this cell line. The isotype control antibody, CNTO9412, did not show significant concentration-dependent cytotoxicity, suggesting target specific internalization of these CD33 antibodies in the MOLM13 cells. Table 15 shows $EC_{50}$ values for five (5) CD33×CD3 bispecific antibodies.

The results also indicated that antibody C33B836 has better internalization in MOLM13 cells than others.

TABLE 14

CD33 internalization assays. Summary of the $EC_{50}$ values for five anti-CD33 antibodies.

| | C33B782 | C33B806 | C33B836 | C33B904 | C33B937 | CNTO9412 |
|---|---|---|---|---|---|---|
| $EC_{50}$ (nM) | 0.88 | 0.22 | 0.04 | 0.96 | 1.92 | |

Example 11: Demonstration that the CD33 Antibodies can Mediate ADCC Activity

To characterize the antibody-dependent cell-mediated cytotoxicity (ADCC) activity of anti-CD33 mAbs, in vitro ADCC assays were conducted utilizing healthy donor NK effector cells and MOLM-13 and MV4-11 AML target cells. Healthy donor NK cells (BIOLOGICAL SPECIALTY® Corporation donor CC00061 and M7015; Colmar, Pa.) were plated in MYELOCULT™ H5100 growth media (STEMCELL TECHNOLOGIES™; Vancouver, Calif.) supplemented with $1 \times 10^{-6}$ M hydrocortisone (STEMCELL TECHNOLOGIES™), 7.5 ng/ml recombinant human IL-2 (R&D Systems; Minneapolis, Minn.), 1% sodium pyruvate (LIFE TECHNOLOGIES™), 1% non-essential amino acids (LIFE TECHNOLOGIES™), 1% penicillin streptomycin (LIFE TECHNOLOGIES™) 16-24 hours prior to initiating ADCC assays. The day of the assay, $1 \times 10^6$ cells/ml of MOLM-13 and MV4-11 cells were labeled with 10 μM calcein AM at 37° C. for 30 minutes. After labeling, cells were washed three times to remove excess calcein AM. Subsequently, $1 \times 10^5$ calcein AM labeled MOLM-13 or MV4-11 target cells were incubated for 1.5 hours at 37° C. with healthy donor NK cells ($3 \times 10^5$) in the presence of varying concentrations of anti-CD33 antibodies. Maximum lysis control samples were generated by addition of TRITON®-X100 to designated control sample wells at a final concentration of 0.5%. Calcein AM release was measured by fluorescence at 485-535 nm with a SPECTRAMAX® M5 multimode plate reader (MOLECULAR DEVICES®, LLC; Sunnyvale, Calif., USA). Percent cell lysis was determined by normalizing the data to maximal (TRITON® X100 mediated) and minimal (effector cells alone) lysis using the following equation. % Lysis=[(Experimental lysis−Spontaneous lysis)/(Max Lysis−Spontaneous lysis)]*100.

IgG1 low fucose anti-CD33 antibodies induced ADCC in a concentration dependent manner (FIG. 11). C33B48.CLF demonstrated more potent ADCC activity against MOLM-13 and MV4-11 cells than C33B912.CLF with 12-23 fold higher half maximal effective concentration values ($EC_{50}$, Table 16). Maximal lysis of MOLM-13 and MV4-11 cells in response to C33B48.CLF and C33B912.CLF were similar.

TABLE 16

CD33 ADCC assays. Summary of the $EC_{50}$ values for 2 anti-CD33 antibodies and 2 cell lines

|  | $EC_{50}$ ADCC C33B48.CLF (nM) | $EC_{50}$ ADCC C33B912.CLF (nM) |
|---|---|---|
| MOLM-13 | 0.023 | 0.292 |
| MV4-11 | 0.113 | 2.008 |

Example 12: Binding Characteristics of C3CB189 Antibody that Targets CD33, an Antigen Abundantly Expressed by Leukemic Blasts C3CB189 is a fully human immunoglobulin G (IgG)4-PAA bispecific antibody targeting the CD3 receptor complex on T cells and CD33 on myeloid cells. C3CB189 binds to human recombinant (r)CD33 with an affinity ($K_d$) of 0.89 μM and to cynomolgus (cyno) rCD33 with an affinity ($K_d$) of 363 μM. C3CB189 also binds to human and cyno monkey rCD3ε with affinities ($K_d$) of 151.32 and 43.83 nM, respectively. C3CB189 bound specifically to CD33 expressing AML cells lines KG-1, MOLM-13, Kasumi-1 and OCI-AML3 (FIG. 12). A similar binding pattern was seen with the negative control CD33-null antibody, as expected, since it contains a single anti-CD33 Fab arm. Negative control bispecific antibodies null×CD3 as well as null×null showed no significant binding on these cells. None of the bispecific antibodies tested bound to the CD33-negative cell lines, CARNAVAL and KG-1 ACD33 i.e., KG 1 cells with genetic deletion of CD33 using CRISPR (FIG. 12). Additionally, in contrast the parental HEK-293T cells, C3CB189 bound to HEK 293T cells expressing cyno CD33, demonstrating cyno cross-reactivity (FIG. 12).

Example 13: C3CB189 Kills CD33+ AML Cell Lines and Activates T Cells In Vitro

A T cell mediated cytotoxicity assay was next used to evaluate the activity of C3CB189 in vitro in various cell lines including CD33+ cell lines such as MOLM-13, KG-1, SKNO-1, Kasumi-1, and OCI-AML3 as well as $CD33^{no/low}$ cell lines such as CARNAVAL and KG1ACD33. The assays were set up with isolated pan human CD3+ T cells from six healthy donors and fragment crystallizable region (Fc) blocker. An Fc blocker was added to prevent Fc-mediated recruitment of C3CB189 since the PAA mutations in the IgG4 Fc region do not render it completely silent (Vafa et al., 2014) and because Fc gamma receptors (FcγR) are often expressed on AML cells (Ball et al., 1989).

As seen in FIG. 13, C3CB189 demonstrated T cell-mediated cytotoxicity of CD33+ AML cell lines when combined with purified T cells after 48 hours (FIG. 13). The median half-maximal effective concentration ($EC_{50}$) [as well as $EC_{20}$ values] for MOLM-13, KG-1, Kasumi-1, and OCI-AML3 were 0.1307 [0.0283], 0.1677 [0.0525], 0.05 [0.0366], and 0.1826 [0.0844] nM, respectively (FIG. 15A). No cytotoxicity was observed with the CD33-negative cell lines CARNAVAL and KG-1ACD33 or with control bispecific antibodies (null×CD3 or CD33×null; see FIG. 13). We confirmed that KG1ACD33 cells could indeed be targeted by T cells, by performing cytotoxicity assays with a CD123× CD3 bispecific antibody (FIG. 14A).

The extent of T cell activation induced by C3CB189 in the presence of CD33' tumor cell lines was also evaluated in vitro in the cytotoxicity assays, with CD25 expression measured as an indicator of activation. As shown in FIG. 15B, C3CB189 induced T cell activation when incubated with CD33+ tumor cell lines and healthy donor pan T cells, while minimal or no T cell activation was observed with CD33-CARNAVAL and KG-1ΔCD33 cells. The median $EC_{50}$ [$EC_{20}$] values for MOLM-13, KG-1, Kasumi-1, and OCI-AML3 were 0.0283 [0.0077], 0.0664 [0.0256], 0.0432 [0.0267], and 0.0500 [0.0178] nM, respectively (FIG. 15C). C3CB189 did not cause activation of T cells in the absence of target cells, demonstrating the specificity of T cell activation (FIG. 14B). The CD33×null control antibody did not induce T cell activation in any cell lines. The null×CD3 control antibody induced T cell activation at the highest concentrations of 533 and 53 nM in the presence of CD33+ and CD33+ cell lines but failed to mediate activation at any other dose. Importantly, C3CB189 showed specific induction of T cell activation, only in the presence of CD33+ cell lines and not in the presence of CD33⁻ cell lines (FIG. 15A) or when T cells were incubated in the absence of target cells (FIG. 14B).

Lastly, cytokine responses were also assessed in the above in vitro T cell redirection assay with Kasumi-1 cell line. C3CB189 led to the secretion of several cytokines including interferon gamma (IFN-γ), tumor necrosis factor alpha (TNF-α), interleukin (IL)-2, and IL-8. These data are consistent with the cytotoxicity and T cell activation data shown in FIG. 13 and FIG. 15A-15C A summary of median $EC_{50}$ and concentration producing 20% of the maximum possible effect ($EC_{20}$) values for the cytokine responses is reported in Table 17.

TABLE 17

Effective concentration values for C3CB189-mediated cytokine release in a T cell redirection assay with purified T Cells and Kasumi-1 target cells. EC values are in nM. n represents the number of donors out of 6 for which EC values could be determined.

| Cytokine | n | Median $EC_{20}$ | Median $EC_{50}$ | Median $EC_{90}$ |
|---|---|---|---|---|
| IFN-gamma | 6 | 0.048 | 0.16 | 1.409 |
| IL-1beta | 6 | 0.013 | 0.045 | 0.226 |
| IL-2 | 4 | 0.090 | 0.346 | 5.282 |
| IL-4 | 4 | 0.054 | 0.078 | 0.153 |
| IL-8 | 6 | 0.015 | 0.042 | 0.246 |
| IL-10 | 6 | 0.052 | 0.123 | 1.271 |
| IL-13 | 5 | 0.008 | 0.034 | 0.103 |
| TNF-alpha | 6 | 0.049 | 0.208 | 3.530 |

Example 14: C3CB189 Shows Effective Anti-Tumor Activity In Vivo

The function of C3CB189 in two established xenograft tumor models in T cell humanized NSG mice was evaluated. In established subcutaneous KG-1 tumor-bearing mice, treatment with C3CB189 at 0.1, 0.5, and 1 mg/kg elicited tumor growth inhibition of 41%, 92%, and 87%, respectively, compared with null×CD3 treated control animals ($p<0.0001$ for 0.5 and 1 mg/kg, FIG. 16A). C3CB189 at 0.5 and 1 mg/kg also resulted in 6 and 7 complete responses at Day 55, respectively.

In the established disseminated luciferase expressing MOLM-13 model (MOLM-13-luc), C3CB189 treatment was initiated after homing of AML cells to bone marrow (BM) was confirmed following intravenous injection. C3CB189 at 0.005, 0.05, and 0.5 mg/kg was administered every 3 to 4 days significantly inhibited tumor growth as assessed by bioluminescence (76%, 100%, and 82%, respectively) compared with null×CD3 control treated mice (FIG. 17). C3CB189 at 0.005, 0.05, and 0.5 mg/kg resulted in a statistically significant increased life span of 19%, 72%, and 50%, respectively ($p<0.0001$, FIG. 16B) correlating with reduced tumor burden in the BM, spine and hind limb as observed by bioluminescence (FIG. 16C). At the end of the study on Day 55, three animals treated with C3CB189 at 0.05 mg/kg showed complete response as assessed by BLI.

Furthermore, MOLM-13-luc tumor-bearing mice treated with C3CB189 at 0.05 mg/kg, and to a lesser extent at 0.005 mg/kg, showed decreased tumor cells and increased CD3$^+$ T cell infiltration in the bone marrow as measured by flow cytometry (FIG. 16D) and increased CD8$^+$ T cell infiltration by IHC (FIG. 16E) on Day 11. These data are relevant as the BM is often a site of resistance for leukemic stem cells (LSCs) in AML and persistence of minimal residual disease. Together, these data demonstrate that C3CB189 inhibits tumor growth of two AML tumor models by recruiting T cells to the tumor site in T cell humanized mice.

Example 15: C3CB189 Mediates Cytotoxicity of AML Cells Spiked in Healthy Whole Blood as Well as AML Blasts from Primary Patient Samples The extracellular domain (ECD) of CD33 is reported to be shed from cells; therefore normal and patient samples could contain soluble CD33 (sCD33). A study showed that there is approximately 4-30 ng/mL of sCD33 detected in the plasma of AML patients (Biedermann, B., Gil, D., Bowen, D. T., and Crocker, P. R. (2007). Leuk Res 31, 211-220.). This value is higher than 0.6-5.8 ng/mL concentration determined in healthy human serum (Biedermann, B., Gil, D., Bowen, D. T., and Crocker, P. R. (2007). Leuk Res 31, 211-220.).

To determine the physiological sCD33 levels in normal and AML donors, an immunocapture coupled mass spectrometry (MS) assay was developed. Analysis of the normal and AML serum samples showed similar mean sCD33 levels of 53.03 ng/mL (1.91 nM) and 52.90 ng/mL (1.90 nM), respectively (Table 18).

TABLE 18

Assessment of sCD33 levels in normal and AML patient samples. Healthy human and AML serum samples (n = 20/each) were analyzed for sCD33 levels using mass spectroscopy.

| | Sample | Concentration (nM) | Concentration (ng/mL) |
|---|---|---|---|
| Normal Human Serum (NHS) | Individual 1 | 0.23 | 6.15 |
| | Individual 2 | NR | NR |
| | Individual 3 | NR | NR |
| | Individual 4 | 0.21 | 5.59 |
| | Individual 5 | NR | NR |
| | Individual 6 | 0.25 | 6.73 |
| | Individual 7 | 0.24 | 6.39 |
| | Individual 8 | NR | NR |
| | Individual 9 | 0.23 | 6.14 |
| | Individual 10 | 0.21 | 5.69 |
| | Mean NHS (Reportable) | 0.23 | 6.12 |
| AML Donor Serum (AML) | AML Donor 1 | 0.14 | 3.76 |
| | AML Donor 2 | 0.14 | 3.71 |
| | AML Donor 3 | NR | NR |
| | AML Donor 4 | 0.15 | 3.92 |
| | AML Donor 5 | 0.16 | 4.32 |
| | AML Donor 6 | 0.13 | 3.61 |
| | AML Donor 7 | NR | NR |
| | AML Donor 8 | 0.17 | 4.44 |
| | AML Donor 9 | 0.14 | 3.81 |
| | AML Donor 10 | NR | NR |
| | Mean AML (Reportable) | 0.15 | 3.94 |

To assess the activity of C3CB189 in a more physiologically relevant setting, we performed T cell mediated cytotoxicity assays using human peripheral whole blood as a source of effector T cells, with various CD33$^+$ tumor cells added as targets and incubated for 48 hours. C3CB189 induced T cell-mediated cytotoxicity of CD33$^+$ MOLM-13 and Kasumi-1 cells, with median $EC_{50}$ [$EC_{20}$] values of 0.111 [0.054] and 0.124 [0.06] nM, respectively (FIG. 17). Similarly, C3CB189 led to the activation of T cells (as indicated by CD25), MOLM-13, and Kasumi-1 cells, with median $EC_{50}$ [$EC_{20}$] values of 0.037 [0.017] and 0.085 [0.039] nM, respectively (FIGS. 18A and 18B). The measured C3CB189-mediated T cell activation represents the total T cell activation in the blood, and it reflects activation related to the killing of both exogenous CD33$^+$ tumor cells and possibly endogenous CD33$^+$ peripheral leukocytes, such as neutrophils and monocytes that were not measured for cytotoxicity in this assay. Additionally, these data suggest that C3CB189 mediates tumor cell killing despite the presence of baseline levels of sCD33 and other CD33$^+$ leukocytes in whole blood.

The ability of C3CB189 to induce cytotoxicity in a more clinically relevant context was next assessed in an ex vivo cytotoxicity assay using whole blood from AML donors. This system relies on the presence of autologous T cells in the patient's own blood to kill AML cells. The extent of T cell-mediated cytotoxicity of CD33$^+$ cells and T cell activation were measured. C3CB189 induced a concentration-dependent cytotoxicity of CD33$^+$ blasts (FIG. 19A) that also correlated with increased T cell activation (FIG. 19B) in all 6 patient samples. The maximal cytotoxicity induced by C3CB189 was approximately 60% of the CD33$^+$ blasts. The null arm control antibody induced limited cytotoxicity and T cell activation. C3CB189 induced cytotoxicity and T cell activation that resulted in $EC_{50}$ values that ranged from 0.052 to 9.52 nM (median: 0.365 nM) and 0.03 to 5.109 nM (median: 0.355 nM), respectively (FIGS. 19A and 19B). These data indicate that C3CB189 was effective in killing CD33+ AML cells in a more physiologic ex vivo setting and in the presence of baseline sCD33 levels.

Example 16: Assessment of Cynomolgus Cross-Reactivity for C3CB189

To assess if the cynomolgus (cyno) monkey was an appropriate model to evaluate the activity of C3CB189, we first investigated by FACS analysis the CD33 expression on leukocytes obtained from 6 healthy cyno monkeys. T and B cells in cyno monkey peripheral blood were found to have low to zero levels of CD33 expression (FIG. 20). Approximately 75% to 96% of cyno neutrophils expressed CD33 at a mean antigen density of 7,545 molecules/cell (FIG. 20). On the other hand, the percentage of CD33+ cyno monocytes was variable among the 6 donors, ranging from 0% to 84% with a mean antigen density of 2,146 molecules/cell (FIG. 20).

Next to demonstrate cyno cross-reactivity and to assess the cytotoxicity potential of C3CB189 at eliminating normal cyno monkey monocytes and neutrophils, we performed ex vivo cytotoxicity assays using healthy cyno monkey whole blood with exogenously added CD33+ MOLM-13 cells was utilized. In this system, depletion of CD33+ normal cyno monkey monocytes and normal cyno monkey neutrophils were also monitored along with activation of T cells. Indeed, C3CB189 mediated killing of CD33+ MOLM-13 cells ($EC_{50}$: 0.013-0.452 nM) along with CD33+ normal cyno monkey monocytes ($EC_{50}$: 0.625-5.636 nM) and normal cynomolgus monkey neutrophils ($EC_{50}$: 0.013-0.714 nM) in vitro after 48 hours of ex vivo incubation (FIG. 21). The null×CD3 control showed limited cytotoxicity of all CD33 target cells and showed T cell activation only at the highest dose of 533 nM. Together, these data show functional cynomolgus monkey cross-reactivity of C3CB189 and establish CD33+ cyno monocytes and neutrophils as potential pharmacodynamic (PD) markers in non-human primate studies. These data also show that C3CB189 can mediate depletion of a human AML cell line by cyno T cells. Importantly, these results validate the cynomolgus monkey as an appropriate efficacy model for C3CB189.

Example 17: C3CB189 Mediates Reduction of CD33+ Leukocytes in Cynomolgus Monkeys To assess the pharmacokinetics (PK) and pharmacodynamics (PD) of C3CB189 in vivo, C3CB189 was administered as a single IV dose to cyno monkeys. The PK profiles are shown in FIG. 22A. C3CB189 exhibited PK characteristics of a typical monoclonal antibody (mAb) with approximately linear PK over the 0.05-1 mg/kg dose range. The estimated mean total clearance of C3CB189 was 13.03 to 21.39 mL/day/kg, volume of distribution was 89.14 to 154.91 mL/kg, and terminal half-life was 4.20 to 5.06 days. An apparently accelerated elimination of C3CB189 after Day 10 in the 1 mg/kg dose group animals was observed. This is most likely related to the development of anti-drug antibodies (ADAs), though ADA was not tested in this study.

Consistent with the anticipated mechanism of action, dose-dependent increases in T cell activation (% CD25+) were observed following a single IV dose of C3CB189, with peak % CD25+ on T-cytotoxic lymphocytes (CD8+/CD4−) observed at the first time point at 24 hours post dose (FIG. 22B). The T-helper lymphocytes (CD4+/CD8−) also exhibited similar activation (% CD25+) profiles after C3CB189 dosing (data not shown). C3CB189 administration also resulted in a dose-dependent increase in plasma concentrations of the cytokines being analyzed (IFNγ, IL-10, IL-2, IL-6, MCP-1, and TNFα) at 2 hours postdose (FIG. 23). With the exception of IL-10 and MCP-1, the cytokines went back to below lower limit of quantification (LLOQ) levels by 24 hours postdose.

Dosing of C3CB189-related led to sustained reduction in CD33+ granulocytes (neutrophils). Consistent with the lower CD33 expression levels on monocytes, a more transient reduction in CD33+ monocytes was also observed. The concentration-time profiles for granulocytes and monocytes are shown in FIG. 22C and FIG. 22D, respectively. Though the initial rapid disappearance of granulocytes and monocytes from peripheral blood could be related to the transient leukocyte margination associated with T cell activation, the reduction of CD33+ granulocytes/monocytes populations was much more sustained. In particular, reduction of the granulocyte populations continued to be at near-maximum level through Day 8, and gradually recovered after that. The rebound of monocytes happened earlier and was more prominent.

C3CB189 was also studied in another two cynomolgus monkey studies following multiple IV administrations at dose levels ranging from 0.01 mg/kg to 30 mg/kg. C3CB189 related changes were generally consistent with that observed following a single dose and C3CB189 was well tolerated at these dose levels (data not shown). Together these data provide evidence of C3CB189 mediating activity while maintaining tolerability in cynomolgus monkeys.

Example 18: C3CB189-Mediated Cytotoxicity of CD33+ Cell Lines and Patient Samples Regardless of Genotypes of Rs12459419 SNP An SNP, rs12459419 (C>T; Ala14Val in exon 2) occurs within a regulatory splice site of CD33, in which a T allele results in increased expression of transcripts predicted to code for a CD33 protein isoform lacking the V set domain. Recent data further demonstrated subjects with SNP rs12459419 CC genotype (about 50% of study entrants) had a significantly lower risk of relapse and better event-free survival (EFS) and disease-free survival after GO therapy, whereas this benefit was not seen in patients with the CT or TT genotypes (Lamba, J. K., Chauhan, L., Shin, M., Loken, M. R., Pollard, J. A., Wang, Y. C., Ries, R. E., Aplenc, R., Hirsch, B. A., Raimondi, S. C., et at. (2017). J Clin Oncol 35, 2674-2682.). Given the data with GO in the above-mentioned study, we assessed the impact of SNP-rs12459419 genotypes on the activity of C3CB189. We first confirmed via hydrogen deuterium exchange (HDX) mapping, that C33B904 ($IgG_4$ version of the CD33 parental arm of C3CB189) binds to distinct regions in the C2 domain (IgC in FIG. 24A) of CD33 and has no binding in the V region (IgV in FIG. 24A). In contrast, C33B836 ($IgG_4$ version of the CD33 parental arm of C3CB97) binds to the V domain of CD33 and has no binding in the C2 region of CD33. We next used in vitro T cell-mediated cytotoxicity assays to compare responses mediated by C3CB97 (V binder) to C3CB189 (C2 binder). Based on genotyping data (FIG. 25A), KG-1, SH2, and OCI-AML3 were chosen to represent wild-type CC, heterozygous CT, and homozygous TT for the CD33 SNP rs12459419 mutation, respectively. Unlike the null×CD3 control, V- and C2-binding CD33×CD3 bispecific antibodies induced T cell-redirected cell cytotoxicity of CD33+ KG-1 "CC" cell line at 48 h (FIG. 24B). In contrast, unlike V-binder C3CB97, only the C2-binding C3CB189 mediated cytotoxicity of SH2 "CT" cell line and OCI-AML3 "TT" cell lines while no activity was observed for V-binder C3CB97.

We then performed ex vivo cytotoxicity assays using AML patient whole blood to extend and confirm our above observations. Based on genotyping data, patient samples 6095, 6116, and 6152 were identified as being CC genotype, while patient samples 6129 and USAML0078 were identified as being heterozygous CT for the CD33 SNP rs12459419, respectively (FIG. 25B) No samples were identified as being homozygous TT for the CD33 SNP rs12459419. V-binding and C2-binding CD33×CD3 bispecific antibodies indeed induced comparable T cell-redirected cell cytotoxicity of AML samples that were identified as CC genotype; in contrast, C2-binding C3CB189 showed enhanced cytotoxicity of AML samples that were heterozygous (CT) for SNP rs12459419 mutation, compared to the V-binding C3CB97 (FIG. 24B). Next, given that SNP rs12459419 is a germline mutation, we conducted similar ex vivo experiments with purified monocytes and matched autologous T cells from 25 different healthy donors. Genotyping data for all 25 donors is shown in FIG. 25C. Consistent with the fact that C3CB189 binds to the C2 domain of CD33, C3CB189 mediated cytotoxicity of primary human monocytes regardless of their SNP genotype status (see FIG. 24C). In contrast, V binding C3CB97 mediated limited to no cytotoxicity when samples were CT or TT for SNP rs12459419. Together, these three lines of evidence suggest that C3CB189 could demonstrate efficacy in a broader group of AML patients by targeting the conserved C2 epitope.

It will be appreciated by those skilled in the art that changes could be made to the embodiments described above without departing from the broad inventive concept thereof. It is understood, therefore, that this invention is not limited to the particular embodiments disclosed, but it is intended to cover modifications within the spirit and scope of the present invention as defined by the present description.

TABLE 19

Heavy Chain Variable Region Sequences

| HC ID | ID | Amino Acid Sequence |
|---|---|---|
| B23H1 | 256 | QITLKESGPTLVKPTQTLTLTCTFSGFSLSTSGMGVSWIRQPPGKALEWLAHIYWDDD KRYNPSLKSRLTITKDTSKNQVVLTMTNMDPVDTATYYCARLYGFTYGFAYWGQG TLVTVSS |
| CD3H141 | 257 | EVQLVESGGGLVQPGGSLRLSCAASGFTFNTYAMNWVRQAPGKGLEWVARIRSKY NNYATYYAASVKGRFTISRDDSKNSLYLQMNSLKTEDTAVYYCARHGNFGNSYVS WFAYWGQGTLVTVSS |
| CD3H219 | 258 | QVQLQQSGPRLVRPSQTLSLTCAISGDSVFNNNAAWSWIRQSPSRGLEWLGRTYYRS KWLYDYAVSVKSRITVNPDTSRNQFTLQLNSVTPEDTALYYCARGYSSSFDYWGQG TLVTVSS |
| C33H42 | 259 | QLQLQESGPGLVNPSETLSHTCTVSGGSISSSSHYWGWIRQPPGKGLEWIGKIYYSGN TYYNPSLKSRVTISIDTSKNQFSLKMSSVTAADTAVYYCARLADVVVVPAARYFDS WGQGTLVTVSS |
| C33H44 | 260 | QVQLQQSGPGLVKPSQTLSLTCAISGDSVSSNSAAWNWIRQSPSRGLEWLGRTYYRS KWYNDYAVSVRSRITINPDTSKNQFSLQLNSVTPEDTAVYHCARETMFRGLMDYWG QGTLVTVSS |
| C33H45 | 261 | QVQLVESGGGVVQPGRSLRLSCAASGFTFSSYGMHWVRQSPGKGLEWVAVISYDGS NKYCADSVKGRFTISRDNSKSTLYLQMNSLRAEDTAVYYCAKDFRSLDWLPPDSTS YDGMDVWGQGTTVTVSS |
| C33H46 | 262 | QVQLVQSGSELKKPGASVKVSCKASGYTFTNYAMNWVRQAPGQGLEWMGWINTN TGNPTYAQAFTGRFVFSLDTSVSTAYLQISSLKAEDTAVYYCARDREVRDYWGQGT LVTVSS |
| C33H48 | 263 | QLQLQESGPGLVKPSETLSLTCTVSGGSIRSTNYYWGWIRQPPGKGLEWIGTIYYSGN TYYNPSLKSRVTISVDTSKNQFSLKLSSVTAADTAVYYCARLADVVVVPAARYFDY WGQGILVTVSS |
| C33H49 | 264 | QLQLQESGPGLVKPSETLSLTCTVSGGSIRSSGFYWGWIRQPPRKGLEWIGTIYYSGN TYYNPSLKSRVTISVDTSKNQFSLKLSSVTAADTAVYFCARLADVVVVPAARYFDN WGQGTLVTVSS |
| C33H51 | 265 | QLQLQESGPGLVKPSETLSLTCTVSGGSISTGRYYWGWIRQPPGKGVIWIGNIYYSGN TYYNPSLKSRVTISVDTSKNQFSLKLNSVTAADTAVYYCARLGSLVVVPAAMSFDY WGQGTLVTVSS |
| C33H52 | 266 | QLQLQESGPGLVKPSETLSLTCTVSGGSIRGSSYYWGWVRQPPGKGLEWIGSIYSSGN TYYNPSLKSRVTISVDTSKNQFSLKLSSVTAADTALYYCARLGSLVVVPAAMSFDY WGQGTLVTVSS |
| C33H55 | 267 | QVQLQESGPGLVKPSGTLSLTCAVSGGSISSSNWWSWVRQPPGRGLEWIGEIYHSGN TNNSPSLKSRVTISADKSKNQFSLKLSSVTAADTAVYFCARIIAVARYFDSWGQGTLV TVSS |
| C33H65 | 268 | QVQLVESGGGVVQPGRSLRLSCAASGFTFSSYGMHWVRQAPGKGLEWVVVISYDG SNKYYADSVKGRFTISRDNSKNTLYLQMNSLRAEDTAVYYCAKDFRDFDWLPPDST SYHGMDVWGQGTTVTVSS |

TABLE 19-continued

Heavy Chain Variable Region Sequences

| HC ID | ID | Amino Acid Sequence |
|---|---|---|
| C33H66 | 269 | QVQLVESGGGVVQPGRSLRLSCVASGFTFSSYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSS |
| C33H68 | 270 | EVQLLESGGGLVQPGGSLGLSCAASGFTFSGYAMSWVRQAPGKGLNWVSAIDYSGNDTYYADSVKGRFTISRDNSKNTLYLQMNSLRAEDTAVYYCAKESQLLHGLIAEHWGQGILVTVSS |
| C33H69 | 271 | QLQLQESGPGLVKPSETLSLTCTVSGGSISSSSYYWGWIRQPPGKGLDWIGSINYSGSTYYNPSLKSRVTISVDTSKIQFSLKLRSVTAADTAVYYCARLDGYESPFDYWGQGTLVTVSS |
| C33H70 | 272 | QLQLQESGPGLVKPSETLSLTCTVSGGSIRGSSYYWGWIRQPPGKGLEWIGSIYSSGNTYYNPSLKSRVTISVDTSKNQFSLKLSSVTAADTAVYYCARLGSLVVVPAAMSFDYWGQGTLVTVSS |
| C33H72 | 273 | EVQLVESGGGLVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSS |
| C33H73 | 274 | EVQLLESGGGLVQPGGSLRLSCAASRFTFSSYAMTWVRQAPGKGLEWVSTINISGGSTYYADSVKGRFTISRDNSKNTLYLQMNSLRAEDTAVYYCTKGGYSSGPFDYWGQGTLVSVSS |
| C33H74 | 275 | QVQLVESGGGVVQPGRSLRLSCAASRFTFSSYGMHWVRQAPGKGLEWVAVISYDGSNKYYADSVKGRFTISRDNSKNTLYLQMNSLRAEDTAVHYCAKDFRSFDWLPPDSASYHGMDVWGQGTTVTVSS |
| C33H76 | 276 | EVQLLESGGGLVQPGGSLRLSCAASGFTFNYAMSWVRQAPGKGLEWVSAISGSGGSTYYADSVKGRFTISRDISKNTLYLQMNSLRAEDTAVYYCARTYNSGYYDGDFDYWGQGTLVTVSS |
| C33H78 | 277 | QVQLVESGGGVVQPGRSLRLSCAASGFTFSSYGMHWVRQAPGKGLEWVAVISYDGSNKYYADSVKGRFTISRDNSKNTLFLQMNSLRAEDTAVYYCAKDFRYFDWLPPDSSSYYGMDVWGQGTTVTVSS |
| C33H80 | 278 | QVQLVQSGSELRKPGASVKVSCKASGYTFTNYAMNWVRQAPGQGLEWMGWINTNTGNPTYAQGFTGRFVFSLDTSVSSAYLQISSLKAEDTAMYYCATDRDRGTDYWGQGTLVTVSS |
| C33H81 | 279 | QVQLVESGGGVVQPGRSLRLSCAASGFTFSAYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSS |
| C33H84 | 280 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDFRSFDWLPPDSTSYYGMDVWGQGTTVTVSS |
| C33H87 | 281 | EVQLVESGGGFVQPGGSLRLSCAASGFTFSSYWMSWVRQAPGKGLEWVANIKQHGSEKYYVDSVKGRFTISRDNVKNSLYLQMNSLRTEDTAVYYCARDRDLGYFDYWGQGTLVTVSS |
| C33H88 | 282 | QVQLVQSGSELKKPGASVKVSCKASGYTLTRSAMNWVRQAPGQGLEWMGWINTNTGNPTYAQGFTGRFVFSLDTSVNTAYLLISSLKTEDTAVYYCASDILPGYHEDYWGQGTLVTVSS |
| C33H90 | 283 | QVQLQQSGPGLVKPSQTLSLTCAISGDSVSSNSAAWNWIRQSPSRGLEWLGRTYYRSKWYNDYALSVQSRITINPDTSKNQFSLQLNSVTPEDTAVYYCAREVAVAASFDYWGQGTLVTVSS |
| C33H91 | 284 | QLQLQESGPGLVKPSETLSLTCTVSGGSISSRSHYWGWIRQPPGVGLEWIGSIYYTGSTYYNPSLKSRVTISVDTSKNQFSLKLSSVTAADTAVYYCARLADIVVVPAARYFDYWGQGTLVTVSS |
| C33H92 | 285 | QLQLQESGPGLVKPSETLSLTCTVSGGSIRSSSYYWGWIRQPPGKGPEWIGSIYSSGNTYYNPSLKSRVTISVDTSKNQFSLKLISMTAADTAVFYCARLAATIVVPAARYFDCWGQGTLVTVSS |
| C33H98 | 286 | EVQLVESGGGFVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSS |
| C33H99 | 287 | EVQLVESGGGLVQPGGSLRLSCAASGFTFSSYWMTWVRPAPGKGLEWVANIKRDGGEKYYVDSVKGRFTISRDNAANSLYLQMNSLRVEDTAVYYCARPFYDHFDYWGQGTLVTVSS |

TABLE 19-continued

Heavy Chain Variable Region Sequences

| HC ID | ID | Amino Acid Sequence |
|---|---|---|
| C33H108 | 288 | QVQLVQSGSELKKPGASVKVSCKASGYTFSTYAMNWVRQAPGQGLEWMGWINTN TGNPTYAQGFTGRFVFSLDTSVSTAYLQISSLKAEDTAVYYCARDRDRGTDYWGQG TLVTVSS |
| C33H249 | 289 | EVQLVESGGGLVQPGRSLRLSCVASGFTFDDYAIHWVRQAPGKGLEWVSGLSWNG GNIGYADSVKGRFTISRDNAKNSLYLQMNSLKTEDTAFYYCTKDTPYGDYFDYWGQ GTLVTVSS |
| C33H250 | 290 | EVQLVESGGGLVQPGRSLRLSCAGSGFTFDDYAIHWVRQAPGKGLEWVSGLSWNG GNIGYADSVKGRFTISRDNAKNSLYLQLNSLKTEDTAFYYCAKDSPYGDYFDYWGQ GTLVTVSS |
| C33H251 | 291 | EVQLVESGGGLVQPGRSLRLSCAASGFTFDDYAMHWVRQAPGKGLEWVSGIGWSG GSIVYADSVKGRFKISRDNAKNSLYLQMNSLRAEDTALYYCAKDSPYGDFFDYWGQ GTLVTVSS |
| C33H252 | 292 | EVQLVESGGGLVQPGRSLRLSCAASGFTFDDYAMHWVRQAPGKGLEWVSGIGWSG GSIVYADSVKGRFTISRDNAKNSLYLQMNSLRAEDTALYYCAKDSPYGDFFDYWGQ GTLVTVSS |
| C33H253 | 293 | EVQLLESGGGLVQPGGSLKLSCTASGFTFRSYAMSWVRQAPGKGLEWVSAINGYGD GRYYADSVKGRFTISRDNSKNTLYLQMNSLRAEDTAVYSCAKDQGFGELFFDYWG QGTLVTVSS |
| C33H254 | 294 | QVQLVESGGGVVQPGRSLRLSCAASGFTFSYYGMHWVRQAPDKGLEWVAVIWFDG NNKYYADSVKGRFTISRDNSKNTLYLQMNSLRAEDTAVYYCARDRELLFDYWGQG TLVTVSS |
| C33H255 | 295 | EVQLVESGGGLVQPGRSLRLSCAASGFTFDDYAMHWVRQVPGEGLEWVSGISWNG GDMVYADSVKGRFTISRDNAKNSLYLQMNSLRPEDTALYYCVKDMPYFDFLTGSD YYYYGMDVWGQGTTVTVSS |
| C33H256 | 296 | QVQLVESGGGVVQPGRSLRLSCATSGFTFSNYGMHWVRQAPGKGLEWVAVIWYVG SHKYYADSVKGRFTISRDNSKNTLYLQMNSLRAEDTAVYYCARDGSLCFDYWGQG TLVTVSS |

TABLE 20

Light Chain Variable Regions

| LC ID | ID | AMINO ACID SEQUENCE |
|---|---|---|
| B23L3 | 297 | DIVMTQSPDSLAVSLGERATINCRASQSVDYNGISYMHWYQQKPGQPPKLLIYAASN PESGVPDRFSGSGSGTDFTLTISSLQAEDVAVYYCQQIIEDPWTFGQGTKVEIK |
| CD3L66 | 298 | QTVVTQEPSLTVSPGGTVTLTCRSSTGAVTTSNYANWVQQKPGQAPRGLIGGTNKR APGTPARFSGSLLGGKAALTLSGVQPEDEAEYYCALWYSNLWVFGGGTKLTVL |
| CD3L150 | 299 | QSALTQPASVSGSPGQSITISCTGTSSNIGTYKFVSWYQQHPDKAPKVLLYEVSKRPS GVSSRFSGSKSGNTASLTISGLQAEDQADYHCVSYAGSGTLLFGGGTKLTVL |
| C33L8 | 300 | SYELTQPPSVSVSPGQTASIICSGDKLGNKYACWYQQKPGQSPVLVIYQDSKRPSGIP ERFSGSNSGNTATLTISGTQAVDEADYYCQAWDSSTYVFGTGTKVTVL |
| C33L10 | 301 | SYVLTQPPSVSVAPGQTARITCGGSNIGSKSVHWYQQKPGQAPVMVVYDDSDRPSGI PERFSGSNSGNTATLTISRVEAGDEADYYCQVWDSSSDVVFGGGTKLTVL |
| C33L11 | 302 | SYELTQPPSVSVSPGQTASITCSGHKLGDKYACWYQQKPGQSPVVVIYKDSKRPSGIP ERFSGSNFGNTATLTISGTQAMDEADYYCQAWDSSTVVFGGGTKLTVL |
| IAPL24 | 303 | SYELTQPPSVSVSPGQTASITCSGDKLGDKYACWYQQKPGQSPVLVIYQDSKRPSGIP ERFSGSNSGNTATLTISGTQAMDEADYYCQAWDSSTVVFGGGTKLTVL |
| C33L58 | 304 | SYELTQPPSVSVSPGQTASITCSGDKLGDKYACWYQQKPGQSPVLVIYQDYKRPSGIP ERFSGSNSGNTATLTISGTQAMDEADYYCQAWDSSTYVFGTGTKVTVL |
| C33L59 | 305 | SYELTQPPSVSVSPGQTASITCSGDKLGDKYACWYQQKPGQSPVLVIYQDYKRPSGIP ERFSGSNSGNTATLTISGTQTMDEADYYCQAWDISTYVFGTGTKVTVL |
| C33L34 | 306 | SYELTQPPSVSVSPGQTASITCSGDKLGDKYACWYQLRPGQSPILVIYQDSNRPSGIPE RFSGSNSGNTATLTISGTQAMDEADYYCQAWDSSTWVFGGGTKLTVL |

TABLE 20-continued

Light Chain Variable Regions

| LC ID | ID | AMINO ACID SEQUENCE |
|---|---|---|
| N46L109 | 307 | SYELTQPPSVSVSPGQTASITCSGDKLGDKYACWYQQKPGQSPVLVIYQDSKRPSGIPERFSGSNSGNTATLTISGTQAMDEADYYCQAWDSSTWVFGGGTKLTVL |
| C33L42 | 308 | SYVLTQPPSVSVAPGQTARITCGGNNIGIKSVHWYQQKPGQAPVLVVYDDSDRPPGIPERFSGSNSGNTATLTITRVEAGDEADYYCQVWDSSSDHVVFGGGTKLTVL |
| C33L47 | 309 | SYELTQPPSVSVSPGQTASITCSGDKLGDKYACWYQQKPGQSPVVIYQDRKRPSGIPERFSGSNFGNTATLTISGTQAMDEADYYCQAWDSSTVVFGGGTKLTVL |
| C33L60 | 310 | SYELTQPPSVSVSPGQTASITCSGDKLGDKYACWYQQKPGQSPVLVIYQDGKRPSGIPERFSGSNFGNKATLTISGTQAMDEADYYCQAWDRNTVVFGGGTKLTVL |
| C33L17 | 311 | DIVMTQSPDSLAVSLGERATINCKSSQSVLYSSNNKNYLAWYQQKAGQPPKLLIYWASTRESGVPDRFSGSGSGTDFILIISSLQAEDVAVYYCQQYYGTPWTFGQGTKVEIK |
| C4LL152 | 312 | DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK |
| C33L40 | 313 | SYELTQPPSVSVSPGQTASITCSGNKLGAKFASWYQQKPGQSPVLVIYQDNKRPSGIPERFSGSNSGNTATLTISGTQAVDEADYYCQAWDSSTVVFGGGTKLTVL |
| C33L32 | 314 | SYELTQPPSVSVSPGQTASITCSGDKLGDKYVRWYQQKTGQSPVLVMYQDSKRPSGIRERFYGSNSGNTATPTISGTQAVDEAEYYCQAWDSSTGVVFGGGTKLTVL |
| C33L38 | 315 | SYELTQPPSVSVPPGQTASITCSGDKLGDKYACWYQQKPGQSPVLVIYQDNKRPSGIPERFSGSNSGNTATLTISGTQAMDEADYYCQAWGRNTVVFGGGTKLTVL |
| C33L39 | 316 | QSALTQPASVSGSPGQSIPISSTGTSSDDGKNNIVSWYQQHPGKAPKLMIYKDSKRPSGVSNRFSGSKSGNTASLTISGLQADDEADYHCCSYAGASNHVVFGGGTKLTVL |
| C33L57 | 317 | SYELTQPPSVSVSPGQTASITCSGDELGNKYACWYQQKPGQSPVVVVYQDRKRPSGIPERFSGSNFGNTATLTISGTQAMDEADYYCQAWDSSTVVFGGGTKLTVL |
| C33L73 | 318 | QSALTQPASVSGSPGQSITISCTGTSSDVGDYNYVSWYQQHPGKVPKLMIYDVSNRPSGVSNRFSGSMSGNTASLTISGLQAEDEADYYCSSYSSSSALEVFGGGTKLTVL |
| C33L53 | 319 | SYELTQPPSVSVSPGQTASITCSGDKLGDKYACWYQQKPGQSPVLVIYQDNKRPSGIPERFSGSNSGNTATLTISGTQAMDEADYYCQAWDSNTVVFGGGTKLTVL |
| C33L66 | 320 | SYELTQPPSVSVSPGQTASITCSGDKLGDKYVCWYQQKPGQSPVVIHQDRKRPSGIPERFSGSNFGNTATLTISGTQAMDEADYYCQAWDSSTVVFGGGTKLTVL |
| C33L35 | 321 | SYELTQPPSVSVSPGQTASITCSGDKLGNKYASWYQQKPGQSPVLVIYQDTKRPSGIPERVSGSNSGNTATLTISGTQAMDEADYHCQAWDSSTVVFGGGTKLTVL |
| C33L61 | 322 | QSALTQPASVSGSPGQSITISCTGINSDVGSYDLVSWYQQHPGKAPKLLIYDGSERPSGVFGRFSGSKSDNTTSLTISGLQAEDEAAYYCCSYEVTTTYVVFGGGTKLTVL |
| C33L51 | 323 | SYVLTQPPSVSVAPGQTARITCGGNNIGSKSVHWSQQKPGQAPVLVVYDDSDRPSGIPERFSGSNSGNTATLTISRVEAGDEADYYCQVWDSNSDHVVFGGGTKLTVL |
| C33L44 | 324 | SYELTQPPSVSVSPGQTASITCSGDKLGDKYACWYQQKPGQSPVLVIYQDSNRPSGIPERFSGSNSGNTATLTISETQAMDEADYYCQAWDSSTYVFGTGTKVTVL |
| C33L30 | 325 | SYELTQPPSVSVSPGQTVSISCSGDRLGDKYACWYQQKPGQSPVLVIYQDSKRPSGIPERFSGSNSGNTATLTISGTQAMDEADYYCQAWDSSSYVFGTGTKVTVL |
| C33L69 | 326 | SYELTQPPSVSVSPGQTASITCSGDKLGSKFACWYQQKPGQSPVLVIYQDSKRPSGIPERFSGSNSGNTATLTISGTQAMDEADYYCQAWDSSTVVFGGGTKLTVL |
| C33L37 | 327 | SYVLTQPPSVAVAPGQTARITCGGSNIGKISVHWYQQKAGQAPVLVVHDDRARPSGIPERLSGSNSGTTATLTISRVEVGDEADYYCQVWNSSSVHPVFGGGTKLTVL |
| C33L74 | 328 | QSALTQPASVSGSPGQSITISCTGTSSDVGDDNYVSWYQQHPGKAPKLMIYDVSNRPSGVSNRFSGSKSGNTASLTISGLQSEDEADYYCSSYSSSTTLEVFGGGTKLTVL |
| C33L115 | 329 | DIQMTQSPSSVWASVGDRVTITCRASQGISSWLAWYQQQPGKAPNLLIYRSSSLQSGVPSRFSGSGSGTDFTLTISSLQPEDFATYYCQQDNSFPYTFGQGTKLEIK |
| C33L116 | 330 | DIQMTQSPSSEWASVGDRVTITCRASQGISSWLAWYQQKPGKAPKLLIYGASSWQSGVPSRFSGSGSGTDFTLTISSLQPEDFATYYCQQDNSFPYTFGQGTKLEIK |
| C33L117 | 331 | DIVMTQSPDSLAVSLGERATINCKSSQTVLYSSNNKNYLAWYQQKPGQPPKLLISWASTRKSGVPDRFSGSGSGTDFTLTVSSLQAEDVAVYYCQHYYSTPYTFGQGTKLEIK |

TABLE 20-continued

Light Chain Variable Regions

| LC ID | ID | AMINO ACID SEQUENCE |
|---|---|---|
| C33L118 | 332 | DIVMTQSPDSLAVSLGERATINCKSSQTVFYSSNNKNYLAWYQQKPGQPPKLLISWA STRKSGVPDRFSGSGSGTDFTLTVSSLQAEDVAVYYCQHYYSTPYTFGQGTKLEIK |
| C33L119 | 333 | DIQMTQSPSTLSASVGDRVTITCRASQSISSWLAWYQQKPGKAPKLLIYKASSLESGV PSRFSGSGSGTEFTLTISSLQPDDFATYCCQQYNSYPWTFGQGTKVEEK |
| C33L120 | 334 | SYELTQPPSVSVSPGQTASITCSGDELGDMYACWYQQKPGQSPLVVIYQDSKRPSGIP ERFSGSNSGNTATLTISGTQAMDEAAYYCQTWDTRIAVFGGGTNLTVL |
| C33L121 | 335 | SYELTQPPSVSVSPGQTASITCSGDNLGNEHVCWYHQKPGQSPVLVIYQNNKRPSGIP ERFSGSNSGNTATLSISGTQATDEADYYCQAWDSTTAVFGGGTKLTVL |
| C33L122 | 336 | SYELTQPPSVSVSPGQTANISCSGVTLGYNYAYWYQQKPGQSPILVISQDTQRPSGIPE RFSGSNSGNTATLTISGTQAMDEAAYYCQAWDITTVLFGGGTKLTVL |
| C33L132 | 337 | SYELTQPPSVSVSPGQTASITCSGDKLGDKYASWYQQKPGQSPVLVIYQDGKRPSGIP ERFSGSNFGNKATLTISGTQAMDEADYYCQAWDRNTVVFGGGTKLTVL |
| C33L41 | 338 | SYELTQPPSVSVSPGQTASITCSGDKLGNKYASWYQQKPGQSPVLVIYQDSKRPSGIP ERFSGSNSGNTATLTISGTQAMDEADYYCQAWDSSTVVFGGGTKLTVL |

TABLE 21

Heavy Chain CDR1-3 sequences

| HC ID | ID | CDR1 | ID | CDR2 | ID | CDR3 | ID |
|---|---|---|---|---|---|---|---|
| B23H1 | 256 | GFSLSTSGM | 339 | YWDDD | 340 | LYGFTYGFA | 341 |
| CD3H141 | 257 | GFTFNTY | 342 | RSKYNNYA | 343 | HGNFGNSYVSWFA | 344 |
| CD3H219 | 258 | GDSVFNNNA | 345 | YYRSKWL | 346 | GYSSSFD | 347 |
| C33H42 | 259 | GGSISSSSH | 348 | YYSGN | 349 | LADVVVPAARYFD | 350 |
| C33H44 | 260 | GDSVSSNSA | 351 | YYRSKWY | 352 | ETMFRGLMD | 353 |
| C33H45 | 261 | GFTFSSY | 354 | SYDGSN | 355 | DFRSLDWLPPDSTSYDGMD | 356 |
| C33H46 | 262 | GYTFTNY | 357 | NTNTGN | 358 | DREVRD | 359 |
| C33H48 | 263 | GGSIRSTNY | 360 | YYSGN | 361 | LADVVVPAARYFD | 362 |
| C33H49 | 264 | GGSIRSSGF | 363 | YYSGN | 364 | LADVVVPAARYFD | 365 |
| C33H51 | 265 | GGSISTGRY | 366 | YYSGN | 367 | LGSLVVVPAAMSFD | 368 |
| C33H52 | 266 | GGSIRGSSY | 369 | YSSGN | 370 | LGSLVVVPAAMSFD | 371 |
| C33H55 | 267 | GGSISSSN | 372 | YHSGN | 373 | IIAVARYFD | 374 |
| C33H65 | 268 | GFTFSSY | 375 | SYDGSN | 376 | DFRDFDWLPPDSTSYHGMD | 377 |
| C33H66 | 269 | GFTFSSY | 378 | SYDGSN | 379 | DFRSFDWLPPDSASYHGMD | 380 |
| C33H68 | 270 | GFTFSGY | 381 | DYSGND | 382 | ESQLLHGLFE | 383 |
| C33H69 | 271 | GGSISSSSY | 384 | NYSGS | 385 | LDGYESPFD | 386 |
| C33H70 | 272 | GGSIRGSSY | 387 | YSSGN | 388 | LGSLVVVPAAMSFD | 389 |
| C33H72 | 273 | GFTFSSY | 390 | KQHGSE | 391 | DRDLGYFD | 392 |
| C33H73 | 274 | RFTFSSY | 393 | NISGGS | 394 | GGYSSGPFD | 395 |
| C33H74 | 275 | RFTFSSY | 396 | SYDGSN | 397 | DFRSFDWLPPDSASYHGMD | 398 |
| C33H76 | 276 | GFTFNY | 399 | SGSGGS | 400 | TYNSGYYDGDFD | 401 |
| C33H78 | 277 | GFTFSSY | 402 | SYDGSN | 403 | DFRYFDWLPPDSSSYYGMD | 404 |
| C33H80 | 278 | GYTFTNY | 405 | NTNTGN | 406 | DRDRGTD | 407 |

TABLE 21-continued

Heavy Chain CDR1-3 sequences

| HC ID | ID | CDR1 | ID | CDR2 | ID | CDR3 | ID |
|---|---|---|---|---|---|---|---|
| C33H81 | 279 | GFTFSAY | 408 | SYDGSN | 409 | DFRSFDWLPPDSASYHGMD | 410 |
| C33H84 | 280 | GFTFSSY | 411 | SYDGSN | 412 | DFRSFDWLPPDSTSYYGMD | 413 |
| C33H87 | 281 | GFTFSSY | 414 | KQHGSE | 415 | DRDLGYFD | 416 |
| C33H88 | 282 | GYTLTRS | 417 | NTNTGN | 418 | DILPGYHED | 419 |
| C33H90 | 283 | GDSVSSNSA | 420 | YYRSKWY | 421 | EVAVAASFD | 422 |
| C33H91 | 284 | GGSISSRSH | 423 | YYTGS | 424 | LADIVVVPAARYFD | 425 |
| C33H92 | 285 | GGSIRSSSY | 426 | YSSGN | 427 | LAATIVVPAARYFD | 428 |
| C33H98 | 286 | GFTFSSY | 429 | KQHGSE | 430 | DRDLGYFD | 431 |
| C33H99 | 287 | GFTFSSY | 432 | KRDGGE | 433 | PFYDHFD | 434 |
| C33H108 | 288 | GYTFSTY | 435 | NTNTGN | 436 | DRDRGTD | 437 |
| C33H249 | 289 | GFTFDDY | 438 | SWNGGN | 439 | DTPYGDYFD | 440 |
| C33H250 | 290 | GFTFDDY | 441 | SWNGGN | 442 | DSPYGDYFD | 443 |
| C33H251 | 291 | GFTFDDY | 444 | GWSGGS | 445 | DSPYGDFFD | 446 |
| C33H252 | 292 | GFTFDDY | 447 | GWSGGS | 448 | DSPYGDFFD | 449 |
| C33H253 | 293 | GFTFRSY | 450 | NGYGDG | 451 | DQGFGELFFD | 452 |
| C33H254 | 294 | GFTFSYY | 453 | WFDGNN | 454 | DRELLFD | 455 |
| C33H255 | 295 | GFTFDDY | 456 | SWNGGD | 457 | DMPYFDFLTGSDYYYYGMD | 458 |
| C33H256 | 296 | GFTFSNY | 459 | WYVGSH | 460 | DGSLCFD | 461 |

TABLE 22

Light Chain CDR1-3 sequences

| LC ID | ID | CDR1 | ID | CDR2 | ID | CDR3 | ID |
|---|---|---|---|---|---|---|---|
| B23L3 | 297 | SQSVDYNGISY | 462 | AAS | 463 | IIEDPW | 464 |
| CD3L66 | 298 | STGAVTTSNY | 465 | GTN | 466 | WYSNLW | 467 |
| CD3L150 | 299 | TSSNIGTYKF | 468 | EVS | 469 | YAGSGTL | 470 |
| C33L8 | 300 | DKLGNKY | 471 | QDS | 472 | WDSSTY | 473 |
| C33L10 | 301 | SNIGSKS | 474 | DDS | 475 | WDSSSDV | 476 |
| C33L11 | 302 | HKLGDKY | 477 | KDS | 478 | WDSSTV | 479 |
| IAPL24 | 303 | DKLGDKY | 480 | QDS | 481 | WDSSTV | 482 |
| C33L58 | 304 | DKLGDKY | 483 | QDY | 484 | WDSSTY | 485 |
| C33L59 | 305 | DKLGDKY | 486 | QDY | 487 | WDISTY | 488 |
| C33L34 | 306 | DKLGDKY | 489 | QDS | 490 | WDSSTW | 491 |
| N46L109 | 307 | DKLGDKY | 492 | QDS | 493 | WDSSTW | 494 |
| C33L42 | 308 | NNIGIKS | 495 | DDS | 496 | WDSSSDHV | 497 |
| C33L47 | 309 | DKLGDKY | 498 | QDR | 499 | WDSSTV | 500 |
| C33L60 | 310 | DKLGDKY | 501 | QDG | 502 | WDRNTV | 503 |
| C33L17 | 311 | SQSVLYSSNNKNY | 504 | WAS | 505 | YYGTPW | 506 |
| C4LL152 | 312 | SQGISSW | 507 | AAS | 508 | ANSFPF | 509 |
| C33L40 | 313 | NKLGAKF | 510 | QDN | 511 | WDSSTV | 512 |
| C33L32 | 314 | DKLGDKY | 513 | QDS | 514 | WDSSTGV | 515 |
| C33L38 | 315 | DKLGDKY | 516 | QDN | 517 | WGRNTV | 518 |
| C33L39 | 316 | TSSDDGKNNI | 519 | KDS | 520 | YAGASNHV | 521 |
| C33L57 | 317 | DELGNKY | 522 | QDR | 523 | WDSSTV | 524 |
| C33L73 | 318 | TSSDVGDYNY | 525 | DVS | 526 | YSSSSALE | 527 |
| C33L53 | 319 | DKLGDKY | 528 | QDN | 529 | WDSNTV | 530 |
| C33L66 | 320 | DKLGDKY | 531 | QDR | 532 | WDSSTV | 533 |
| C33L35 | 321 | DKLGNKY | 534 | QDT | 535 | WDSSTV | 536 |
| C33L61 | 322 | INSDVGSYDL | 537 | DGS | 538 | YEVTTTYV | 539 |
| C33L51 | 323 | NNIGSKS | 540 | DDS | 541 | WDSNSDHV | 542 |
| C33L44 | 324 | DKLGDKY | 543 | QDS | 544 | WDSSTY | 545 |
| C33L30 | 325 | DRLGDKY | 546 | QDS | 547 | WDSSSY | 548 |
| C33L69 | 326 | DKLGSKF | 549 | QDS | 550 | WDSSTV | 551 |
| C33L37 | 327 | SNIGKIS | 552 | DDR | 553 | WNSSSVHP | 554 |

TABLE 22-continued

Light Chain CDR1-3 sequences

| LC ID | ID | CDR1 | ID | CDR2 | ID | CDR3 | ID |
|---|---|---|---|---|---|---|---|
| C33L74 | 328 | TSSDVGDDNY | 555 | DVS | 556 | YSSSTTLE | 557 |
| C33L115 | 329 | SQGISSW | 558 | RSS | 559 | DNSFPY | 560 |
| C33L116 | 330 | SQGISSW | 561 | GAS | 562 | DNSFPY | 563 |
| C33L117 | 331 | SQTVLYSSNNKNY | 564 | WAS | 565 | YYSTPY | 566 |
| C33L118 | 332 | SQTVFYSSNNKNY | 567 | WAS | 568 | YYSTPY | 569 |
| C33L119 | 333 | SQSISSW | 570 | KAS | 571 | YNSYPW | 572 |
| C33L120 | 334 | DELGDMY | 573 | QDS | 574 | WDTRIA | 575 |
| C33L121 | 335 | DNLGNEH | 576 | QNN | 577 | WDSTTA | 578 |
| C33L122 | 336 | VTLGYNY | 579 | QDT | 580 | WDITTV | 581 |
| C33L132 | 337 | DKLGDKY | 582 | QDG | 583 | WDRNTV | 584 |
| C33L41 | 338 | DKLGNKY | 585 | QDS | 586 | WDSSTV | 587 |

SEQUENCE LISTING (591 sequences)

SEQ ID NO: 1 - protein, 364 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 2 - protein, 851 aa, Artificial Sequence
  Cyno CD33 ECD-HSA
DPRVRLEVQESVTVQEGLCVLVPCTFFHPVPYHTRNSPVHGYWFREGAIVSLDSPVATNKLDQEVQEETQGRFRLLGDPSRNNCSLSIVDARRRDNGSYFFRMEKGSTKYSYKSTQLSVHVTDLTHRPQILIPGALDPDHSKNLTCSVPWACEQGTPPIFSWMSAAPTSLGLRTTHSSVLIITPRPQDHGTNLTCQVKFPGAGVTTERTIQLNVSYASQNPRTDIFLGDGSGKQGVVQGSGSGSENLYFQGVRSSSDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGSHHHHHH

SEQ ID NO: 3 - skipped

SEQ ID NO: 4 - protein, 718 aa, Artificial Sequence
  Human CD33-V-HSA
DPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 5 - protein, 715 aa, Artificial Sequence
  Human CD33-C2-HSA
VHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 6 - protein, 135 aa, Artificial Sequence
  Human CD33-V-His
DPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRGSHHHHHH

SEQ ID NO: 7 - protein, 132 aa, Artificial Sequence
  Human CD33 C2-His
VHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGSHHHHHH

SEQ ID NO: 8 - protein, 250 aa, Artificial Sequence
  Human CD33 ECD-His
DPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGSHHHHHH

SEQ ID NO: 9 - skipped

SEQ ID NO: 10 - protein, 364 aa, Artificial Sequence; identical to SEQ ID NO: 1
  Human CD33 full length

SEQ ID NO: 11 - protein, 363 aa, Artificial Sequence
  Cyno CD33 full length
MPLLLLPLLWAGALAMDPRVRLEVQESVTVQEGLCVLVPCTFFHPVPYHTRNSPVHGYWFREGAIVSLDSPVATNKLDQEVQEETQGRFRLLGDPSRNNCSLSIVDARRRDNGSYFFRMEKGSTKYSYKSTQLSVHVTDLTHRPQILIPGALDPDHSKNLTCSVPWACEQGTPPIFSWMSAAPTSLGLRTTHSSVLIITPRPQDHGTNLTCQVKFPGAGVTTERTIQLNVSYASQNPRTDIFLGDGSGRKARKQGVVQGAIGGAGVTVLLALCLCLIFFTVKTHRRKAARTAVGRIDTHPATGPTSSKHQKKSKLHGATETSGCSGTTLTVEMDEELHYASLNFHGMNPSEDTSTEYSEVRTQ

SEQ ID NO: 12 - protein, 447 aa, Artificial Sequence
  C33B46 heavy chain
QVQLVQSGSELKKPGASVKVSCKASGYTFSTYAMNWVRQAPGQGLEWMGWINTNTGNPTYAQGFTGRFVFSLDTSVSTAYLQISSLKAEDTAVYYCARDRDRGTDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 13 - protein, 447 aa, Artificial Sequence
  C33B48 heavy chain
QVQLVQSGSELRKPGASVKVSCKASGYTFTNYAMNWVRQAPGQGLEWMGWINTNTGNPTYAQGFTGRFVFSLDTSVSSAYLQISSLKAEDTAMYYCATDRDRGTDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 14 - protein, 455 aa, Artificial Sequence
  C33B52 heavy chain
QLQLQESGPGLVNPSETLSHTCTVSGGSISSSSHYWGWIRQPPGKGLEWIGKIYYSGNTYYNPSLKSRVTISIDTSKNQFSLKMSSVTAADTAVYYCARLADVVVVPAARYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 15 - protein, 452 aa, Artificial Sequence
  C33B54 heavy chain
QVQLQQSGPGLVKPSQTLSLTCAISGDSVSSNSAAWNWIRQSPSRGLEWLGRTYYRSKWYNDYAVSVRSRITINPDTSKNQFSLQLNSVTPEDTAVYHCARETMFRGLMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 16 - protein, 459 aa, Artificial Sequence
  C33B55 heavy chain
QVQLVESGGGVVQPGRSLRLSCAASGFTFSSYGMHWVRQSPGKGLEWVAVISYDGSNKYCADSVKGRFTISRDNSKSTLYLQMNSLRAEDTAVYYCAKDFRSLDWLPPDSTSYDGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 17 - protein, 446 aa, Artificial Sequence
  C33B57 heavy chain
QVQLVQSGSELKKPGASVKVSCKASGYTFTNYAMNWVRQAPGQGLEWMGWINTNTGNPTYAQAFTGRFVFSLDTSVSTAYLQISSLKAEDTAVYYCARDREVRDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 18 - protein, 455 aa, Artificial Sequence
  C33B61 heavy chain
QLQLQESGPGLVKPSETLSLTCTVSGGSIRSTNYYWGWIRQPPGKGLEWIGTIYYSGNTYYNPSLKSRVTISVDTSKNQFSLKLSSVTAADTAVYYCARLADVVVVPAARYFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 19 - protein, 455 aa, Artificial Sequence
  C33B62 heavy chain
QLQLQESGPGLVKPSETLSLTCTVSGGSIRSSGFYWGWIRQPPRKGLEWIGTIYYSGNTYYNPSLKSRVTISVDTSKNQFSLKLSSVTAADTAVYFCARLADVVVVPAARYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 20 - protein, 455 aa, Artificial Sequence
  C33B63 heavy chain
QLQLQESGPGLVKPSETLSLTCTVSGGSISTGRYYWGWIRQPPGKGVIWIGNIYYSGNTYYNPSLKSRVTISVDTSKNQFSLKLNSVTAADTAVYYCARLGSLVVVPAAMSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 21 - protein, 455 aa, Artificial Sequence
  C33B64 heavy chain
QLQLQESGPGLVKPSETLSLTCTVSGGSIRGSSYYWGWVRQPPGKGLEWIGSIYSSGNTYYNPSLKSRVTISVDTSKNQFSLKLSSVTAADTALYYCARLGSLVVVPAAMSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 22 - protein, 449 aa, Artificial Sequence
  C33B66 heavy chain
QVQLQESGPGLVKPSGTLSLTCAVSGGSISSSNWWSWVRQPPGRGLEWIGEIYHSGNTNNSPSLKSRVTISADKSKNQFSLKLSSVTAADTAVYFCARIIAVARYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 23 - protein, 459 aa, Artificial Sequence
  C33B72 heavy chain
QVQLVESGGGVVQPGRSLRLSCAASGFTFSSYGMHWVRQAPGKGLEWVVVISYDGSNKYYADSVKGRFTISRDNSKNTLYLQMNSLRAEDTAVYYCAKDFRDFDWLPPDSTSYHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 24 - protein, 459 aa, Artificial Sequence
  C33B73 heavy chain
QVQLVESGGGVVQPGRSLRLSCVASGFTFSSYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 25 - protein, 455 aa, Artificial Sequence
  C33B75 heavy chain
QLQLQESGPGLVKPSETLSLTCTVSGGSIRGSSYYWGWIRQPPGKGLEWIGSIYSSGNTYYNPSLKSRVTISVDTSKNQFSLKLSSVTAADTAVYYCARLGSLVVVPAAMSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 26 - protein, 448 aa, Artificial Sequence
  C33B77 heavy chain
EVQLVESGGGLVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 27 - protein, 459 aa, Artificial Sequence
  C33B79 heavy chain
QVQLVESGGGVVQPGRSLRLSCAASRFTFSSYGMHWVRQAPGKGLEWVAVISYDGSNKYYADSVKGRFTISRDNSKNTLYLQMNSLRAEDTAVHYCAKDFRSFDWLPPDSASYHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 28 - protein, 451 aa, Artificial Sequence
  C33B80 heavy chain
EVQLLESGGGLVQPGGSLRLSCAASGFTFNYAMSWVRQAPGKGLEWVSAISGSGGSTYYADSVKGRFTISRDISKNTLYLQMNSLRAEDTAVYYCARTYNSGYYDGDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 29 - protein, 459 aa, Artificial Sequence
  C33B82 heavy chain
QVQLVESGGGVVQPGRSLRLSCAASGFTFSSYGMHWVRQAPGKGLEWVAVISYDGSNKYYADSVKGRFTISRDNSKNTLFLQMNSLRAEDTAVYYCAKDFRYFDWLPPDSSSYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 30 - protein, 459 aa, Artificial Sequence
  C33B83 heavy chain
QVQLVESGGGVVQPGRSLRLSCAASGFTFSAYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 31 - protein, 448 aa, Artificial Sequence
  C33B87 heavy chain
EVQLVESGGGFVQPGGSLRLSCAASGFTFSSYWMSWVRQAPGKGLEWVANIKQHGSEKYYVDSVKGRFTISRDNVKNSLYLQMNSLRTEDTAVYYCARDRDLGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 32 - protein, 449 aa, Artificial Sequence
  C33B88 heavy chain
QVQLVQSGSELKKPGASVKVSCKASGYTLTRSAMNWVRQAPGQGLEWMGWINTNTGNPTYAQGFTGRFVFSLDTSVNTAYLLISSLKTEDTAVYYCASDILPGYHEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 33 - protein, 452 aa, Artificial Sequence
  C33B89 heavy chain
QVQLQQSGPGLVKPSQTLSLTCAISGDSVSSNSAAWNWIRQSPSRGLEWLGRTYYRSKWYNDYALSVQSRITINPDTSKNQFSLQLNSVTPEDTAVYYCAREVAVAASFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 34 - protein, 448 aa, Artificial Sequence
  C33B94 heavy chain
EVQLVESGGGFVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 35 - protein, 448 aa, Artificial Sequence; identical to SEQ ID NO: 34
  C33B95 heavy chain

SEQ ID NO: 36 - protein, 447 aa, Artificial Sequence
  C33B96 heavy chain
EVQLVESGGGLVQPGGSLRLSCAASGFTFSSYWMTWVRPAPGKGLEWVANIKRDGGEKYYVDSVKGRFTISRDNAANSLYLQMNSLRVEDTAVYYCARPFYDHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 37 - protein, 450 aa, Artificial Sequence
  C33B101 heavy chain
QLQLQESGPGLVKPSETLSLTCTVSGGSISSSSYYWGWIRQPPGKGLDWIGSINYSGSTYYNPSLKSRVTISVDTSKIQFSLKLRSVTAADTAVYYCARLDGYESPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 38 - protein, 450 aa, Artificial Sequence
  C33B107 heavy chain
EVQLLESGGGLVQPGGSLGLSCAASGFTFSGYAMSWVRQAPGKGLNWVSAIDYSGNDTYYADSVKGRFTISRDNSKNTLYLQMNSLRAEDTAVYYCAKESQLLHGLFEHWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 39 - protein, 448 aa, Artificial Sequence; identical to SEQ ID NO: 31
  C33B120 heavy chain

SEQ ID NO: 40 - protein, 455 aa, Artificial Sequence
  C33B122 heavy chain
QLQLQESGPGLVKPSETLSLTCTVSGGSIRSSSYYWGWIRQPPGKGPEWIGSIYSSGNTYYNPSLKSRVTISVDTSKNQFSLKLISMTAADTAVFYCARLAATIVVPAARYFDCWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 41 - protein, 455 aa, Artificial Sequence
  C33B123 heavy chain
QLQLQESGPGLVKPSETLSLTCTVSGGSISSRSHYWGWIRQPPGVGLEWIGSIYYTGSTYYNPSLKSRVTISVDTSKNQFSLKLSSVTAADTAVYYCARLADIVVVPAARYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 42 - protein, 449 aa, Artificial Sequence
  C33B124 heavy chain
EVQLLESGGGLVQPGGSLRLSCAASRFTFSSYAMTWVRQAPGKGLEWVSTINISGGSTYYADSVKGRFTISRDNSKNTLYLQMNSLRAEDTAVYYCTKGGYSSGPFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 43 - protein, 459 aa, Artificial Sequence
  C33B125 heavy chain
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDFRSFDWLPPDSTSYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 44 - protein, 456 aa, Artificial Sequence
  C33B760 heavy chain
QVQLVESGGGVVQPGRSLRLSCAASGFTFSSYGMHWVRQSPGKGLEWVAVISYDGSNKYCADSVKGRFTISRDNSKSTLYLQMNSLRAEDTAVYYCAKDFRSLDWLPPDSTSYDGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 45 - protein, 456 aa, Artificial Sequence
  C33B777 heavy chain
QVQLVESGGGVVQPGRSLRLSCAASGFTFSSYGMHWVRQAPGKGLEWVVVISYDGSNKYYADSVKGRFTISRDNSKNTLYLQMNSLRAEDTAVYYCAKDFRDFDWLPPDSTSYHGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 46 - protein, 456 aa, Artificial Sequence
  C33B778 heavy chain
QVQLVESGGGVVQPGRSLRLSCVASGFTFSSYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 47 - protein, 445 aa, Artificial Sequence
  C33B782 heavy chain
EVQLVESGGGLVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 48 - protein, 445 aa, Artificial Sequence
  C33B792 heavy chain
EVQLVESGGGFVQPGGSLRLSCAASGFTFSSYWMSWVRQAPGKGLEWVANIKQHGSEKYYVDSVKGRFTISRDNVKNSLYLQMNSLRTEDTAVYYCARDRDLGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 49 - protein, 445 aa, Artificial Sequence
  C33B799 heavy chain
EVQLVESGGGFVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 50 - protein, 447 aa, Artificial Sequence
  C33B806 heavy chain
QLQLQESGPGLVKPSETLSLTCTVSGGSISSSSYYWGWIRQPPGKGLDWIGSINYSGSTYYNPSLKSRVTISVDTSKIQFSLKLRSVTAADTAVYYCARLDGYESPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 51 - protein, 456 aa, Artificial Sequence
  C33B830 heavy chain
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDFRSFDWLPPDSTSYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 52 - protein, 444 aa, Artificial Sequence
  C33B836 heavy chain
QVQLVQSGSELRKPGASVKVSCKASGYTFTNYAMNWVRQAPGQGLEWMGWINTNTGNPTYAQGFTGRFVFSLDTSVSSAYLQISSLKAEDTAMYYCATDRDRGTDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 53 - protein, 456 aa, Artificial Sequence; identical to SEQ ID NO: 46
  C33B937 heavy chain

SEQ ID NO: 54 - DNA, 1801 bp, Artificial Sequence
  C33B46 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtgcagagcggcagcgagctgaagaagcccggagccagcgtgaaggtgagctgcaaggcctccggctacaccttcagcacctacgccatgaactgggtgaggcaagcccctggacagggcctggagtggatgggctggatcaacaccaacaccggcaaccccacctacgcccagggcttcacaggcaggttcgtgttcagcctggacaccagcgtgagcaccgcctacctgcagatcagcagcctgaaagccgaggacaccgccgtgtactactgcgccagggacagggacaggggcacagactactggggccagggcacactggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 55 - DNA, 1801 bp, Artificial Sequence
  C33B48 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtgcagagcggaagcgagctgagaaagcccggcgccagcgtgaaggtgagctgcaaggccagcggctacaccttcaccaactacgccatgaactgggtgaggcaggcccctggacaaggcctggagtggatgggctggatcaacaccaacaccggcaaccccacctacgcccagggctttaccggcaggttcgtgttcagcctggacaccagcgtgagcagcgcctacctgcagatcagcagcctgaaggccgaggacaccgccatgtactactgcgccaccgacagggacaggggaaccgactactggggccagggcacactggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 56 - DNA, 1825 bp, Artificial Sequence
  C33B52 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggagagcggccctggactggtgaaccccagcgagaccctgagccacacctgtaccgtgagcggcggcagcatctccagcagcagccactactggggctggatcagacagccccctggcaagggcctggagtggatcggcaagatctactacagcggcaacacctactacaaccccagcctgaagtccagggtgaccatcagcatcgacacctccaagaaccagttctccctgaagatgagctccgtgaccgccgccgatacagccgtgtactactgcgccaggctggctgatgtggtggtggtgcctgccgccaggtacttcgacagctggggccagggcacactggtgaccgtgagctccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 57 - DNA, 1816 bp, Artificial Sequence
  C33B54 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctgcagcagagcggacccggactggtgaagcccagccagaccctgagcctcacctgcgccatcagcggcgactccgtgagcagcaatagcgccgcctggaactggatcaggcagagccctagcaggggactggagtggctgggcaggacctactacaggagcaagtggtacaacgactacgccgtgagcgtgaggagcaggatcaccatcaaccccgacaccagcaagaaccagttcagcctgcagctgaactccgtgacccccgaggataccgccgtgtaccactgcgccagggagaccatgttcaggggcctgatggactactggggccagggaaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 58 - DNA, 1837 bp, Artificial Sequence
  C33B55 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggagagcggaggcggagtggtgcagcctggcagaagcctgagactgagctgcgccgccagcggcttcaccttcagcagctacggcatgcactgggtgaggcagagccctggcaaaggcctggagtgggtggccgtgatcagctacgacggcagcaacaagtactgcgccgacagcgtgaagggcaggttcaccatcagcagggacaacagcaagagcaccctgtacctgcagatgaacagcctgagggccgaggacaccgccgtgtactactgcgccaaggacttcaggagcctggactggctgccccccgatagcaccagctatgacggcatggacgtgtggggacagggcaccaccgtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 59 - DNA, 1798 bp, Artificial Sequence
  C33B56 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtgcagagcggcagcgagctgaagaaacccggcgccagcgtgaaggtgagctgcaaggcctccggctacaccttcaccaactacgccatgaactgggtgagacaggctcctggccagggcctggagtggatgggctggatcaacacaaacaccggcaaccctacctacgcccaggccttcaccggcaggttcgtgttcagcctggacaccagcgtgagcaccgcctacctgcagatcagcagcctgaaggccgaggacaccgccgtgtactactgcgccagggacagagaggtgagggactactggggccagggcaccctcgtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 60 - DNA, 1825 bp, Artificial Sequence
  C33B61 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggagagcggacctggcctggtgaagcccagcgagacactgagcctgacatgcaccgtgagcggcggcagcatcaggagcaccaactactactggggctggatcaggcagcctcccggaaagggcctggagtggatcggcaccatctactacagcggcaacacctactacaaccccagcctgaagagcagggtgaccatcagcgtggacacctccaagaaccagttcagcctgaagctgtccagcgtgacagccgccgacacagccgtgtactactgcgctagactggccgacgtggtggtggtgcctgccgccaggtacttcgactactggggccagggcatcctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 61 - DNA, 1825 bp, Artificial Sequence
  C33B62 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggagagcggacctggcctggtgaagcccagcgagaccctgagcctgacctgcacagtgagcggcggcagcatcaggtcctccggcttctactggggctggatcaggcagcctcccaggaagggcctggagtggatcggcaccatctactacagcggcaacacctactacaaccccagcctgaagagcagggtgaccatcagcgtggacaccagcaagaaccagttcagcctgaagctgagcagcgtgacagccgccgataccgccgtgtacttctgcgccagactggccgatgtggtggtggtgcctgccgccaggtacttcgacaactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 62 - DNA, 1825 bp, Artificial Sequence
  C33B63 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggaaagcggccctggcctggtgaagccctccgaaaccctgagcctgacatgcaccgtgagcggcggcagcatcagcacaggcaggtactactggggctggatcaggcagcctcctggcaagggcgtgatctggatcggcaacatctactatagcggcaacacctactacaaccctagcctgaagagcagggtgaccatcagcgtggacaccagcaagaaccagttctccctgaagctgaacagcgtgaccgccgccgacacagccgtgtactactgcgccagactgggaagcctggtggtggtgcctgccgccatgagcttcgactactggggacagggcaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 63 - DNA, 1825 bp, Artificial Sequence
  C33B64 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggaaagcggccctggcctggtgaagcctagcgagaccctgagcctgacctgtaccgtgagcggcggcagcatcagaggcagcagctactactggggctgggtgagacagccccctggaaagggcctggagtggatcggcagcatctacagcagcggcaacacctactacaacccctccctcaagtccagggtgaccatcagcgtggacaccagcaagaaccagttcagcctgaagctgagcagcgtgaccgctgccgataccgccctgtactactgcgccagactgggaagcctggtggtggtgcctgccgccatgagcttcgactactggggccagggcacactggtgaccgtgtccagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 64 - DNA, 1807 bp, Artificial Sequence
  C33B66 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtccagctgcaggagagcggacctggcctggtgaagcctagcggcaccctgagcctgacctgtgccgtgagcggaggcagcatcagcagcagcaactggtggagctgggtgagacagcctcctggcagaggcctggagtggatcggcgagatctaccacagcggcaacaccaacaacagccccagcctgaagagcagggtgaccatcagcgccgacaagagcaagaaccagttcagcctgaagctgagcagcgtgaccgctgccgataccgccgtgtacttctgcgccaggatcatcgccgtggccaggtacttcgacagctggggacagggcaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 65 - DNA, 1837 bp, Artificial Sequence
  C33B72 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggagagcggcggaggagtggtgcagcctggaaggagcctgagactgtcctgcgccgctagcggcttcaccttcagcagctacggcatgcactgggtgagacaggctcccggcaagggactggagtgggtggtggtgatcagctacgacggcagcaacaagtactacgccgacagcgtgaagggcaggttcaccatcagcagggacaacagcaagaacaccctgtacctgcagatgaacagcctgagggccgaggacaccgccgtgtactactgcgccaaggacttcagggacttcgactggctgcctcctgatagcaccagctaccacggcatggacgtgtggggccagggaaccaccgtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 66 - DNA, 1837 bp, Artificial Sequence
  C33B73 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggaaagcggcggaggcgtggtgcagcctggaagaagcctgagactgagctgcgtggccagcggcttcacctttagcagctacggcatgcactgggtgaggcaggctcctggcaagggactggagtgggtggccgtgatcagctacgacggcagcaacaagtactacgccgacagcgtgaagggcaggttcaccatcagcagggacaacagcaagaacaccctgtacctgcagatgaacagcctgagagccgagggcaccgccgtgtactactgcgccaaggacttcaggagctttgattggctgccccctgatagcgccagctaccacggcatggacgtgtggggccagggcacaaccgtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 67 - DNA, 1825 bp, Artificial Sequence
  C33B75 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggaaagcggccctggcctggtgaagcccagcgaaaccctgagcctgacctgcacagtgagcggcggcagcatcaggggcagcagctactactggggctggatcagacagccccctggcaagggcctggagtggatcggcagcatctacagcagcggcaacacctactacaaccccagcctgaagagcagagtgaccatcagcgtggacaccagcaagaaccagttcagcctgaagctgagcagcgtgaccgccgctgataccgccgtgtactactgcgccagactgggaagcctggtggtggtgcctgccgccatgtcctttgactactggggccagggaaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 68 - DNA, 1804 bp, Artificial Sequence
  C33B77 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggaggaggactggtgcagcctggaggcagcctgagactgagctgcgccgctagcggcttcaccttcagcagctactggatgagctgggtgagacaggcccctggcaagggactggagtgggtggccaacatcaagcagcacggcagcgagaagtactacgtggatagcgtgaagggcaggttcaccatcagcagggacaacgccaaaaacagcctgtacctgcagatgaacagcctgagggccgaggacaccgccgtgtattactgcgccagggacagggacctgggctacttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 69 - DNA, 1837 bp, Artificial Sequence
  C33B79 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggagagcggaggaggagtggtgcagcctggcaggagcctgagactgagctgcgccgcctccagattcaccttcagcagctacggcatgcactgggtgagacaggcccctggcaaaggcctggagtgggtggccgtgatcagctacgacggcagcaacaagtactacgccgacagcgtgaagggcaggttcaccatcagcagggacaacagcaagaacaccctgtacctgcagatgaacagcctgagagccgaggacaccgccgtgcactactgcgccaaggactttaggagcttcgactggctgccccctgatagcgccagctaccacggcatggacgtgtggggccagggcaccacagtgaccgtgtccagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 70 - DNA, 1813 bp, Artificial Sequence
  C33B80 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctgctggagagcggaggaggcctggtgcaacctggcggaagcctgagactgagctgcgccgccagcggcttcaccttcaactacgccatgagctgggtgaggcaggcccctggaaagggcctggagtgggtgtccgccattagcggaagcggcggcagcacctactacgccgacagcgtgaagggcaggttcaccatcagcagggacatctccaagaacaccctgtacctgcagatgaacagcctgagggccgaggacaccgccgtgtactactgcgccaggacctacaacagcggctactacgacggcgacttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 71 - DNA, 1837 bp, Artificial Sequence
  C33B82 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggagagcggcggaggagtggtgcagcctggcagaagcctgaggctgagctgcgctgcctccggcttcaccttcagcagctacggcatgcactgggtgagacaggcccctggcaagggactggagtgggtggccgtgatcagctacgacggctccaacaagtactacgccgacagcgtgaagggcaggttcaccatcagcagggacaacagcaagaacaccctgttcctgcagatgaacagcctgagggccgaggacaccgccgtgtactactgcgccaaggacttcaggtacttcgactggctgccccccgacagcagcagctactacggcatggacgtgtggggacagggcaccaccgtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 72 - DNA, 1837 bp, Artificial Sequence
  C33B83 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggagagcggaggaggcgtggtgcagcctggaaggtccctgagactgagctgcgctgccagcggcttcaccttcagcgcctacggcatgcactgggtgagacaggcccctggcaaaggcctggaatgggtggccgtgatcagctacgacggcagcaacaagtactacgccgacagcgtgaagggcaggttcaccatcagcagggacaacagcaagaacaccctgtacctgcagatgaacagcctgagggccgagggcaccgctgtgtactactgcgccaaggacttcaggagcttcgactggctgccccccgatagcgccagctaccacggcatggacgtgtggggccagggaaccaccgtgaccgtgagctccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 73 - DNA, 1804 bp, Artificial Sequence
  C33B87 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggcggaggattcgtgcagcccggaggaagcctgagactgagctgcgccgccagcggcttcaccttcagctcctactggatgagctgggtgagacaggctcccggcaagggactggagtgggtggccaacatcaagcagcacggcagcgagaagtactacgtggacagcgtgaagggcaggttcaccatcagcagggacaacgtgaagaacagcctgtacctgcagatgaacagcctgaggaccgaggacaccgccgtgtactactgcgccagggacagggacctgggctacttcgactactggggccagggaaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 74 - DNA, 1807 bp, Artificial Sequence
  C33B88 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtgcagagcggaagcgagctgaagaagcccggcgcctccgtgaaggtgagctgcaaggccagcggctacaccctgaccagaagcgccatgaactgggtgagacaggctcctggccagggcctggagtggatgggctggatcaacaccaacaccggcaaccccacctacgcccagggctttaccggcaggttcgtgttcagcctggacaccagcgtgaacaccgcctacctgctgatcagcagcctgaagaccgaggacaccgccgtgtactactgcgcctccgacatcctgcccggctaccacgaggactactggggccagggcacactggtgaccgtgagctccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 75 - DNA, 1816 bp, Artificial Sequence
  C33B89 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctgcagcagagcggccctggcctggtgaagcctagccagaccctgagcctgacctgcgccatcagcggcgatagcgtgtccagcaactccgccgcctggaactggatcaggcagagccctagcagaggcctggagtggctgggcaggacctactacaggagcaagtggtacaacgactacgccctgagcgtgcagtccaggatcaccatcaaccccgacaccagcaagaaccagttctccctgcagctgaactccgtgacccccgaggacaccgccgtgtactactgcgctagagaggtggccgtggccgccagcttcgattactggggccagggcacactggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 76 - DNA, 1804 bp, Artificial Sequence
  C33B94 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggaggcggatttgtgcagcctggcggcagcctgagactgagctgtgccgccagcggcttcaccttcagcagctactggatgagctgggtgaggcaggcccctggaaagggactggagtgggtggccaacatcaagcagcacggaagcgagaagtactacgtggacagcgtgaagggaaggttcacaatcagcagggacaacgccaagaacagcctgtacctgcagatgaacagcctgagggccgaggacaccgccgtgtactactgcgccagggacagggacctgggctacttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 77 - DNA, 1804 bp, Artificial Sequence; identical to SEQ ID NO: 76
  C33B95 heavy chain

SEQ ID NO: 78 - DNA, 1801 bp, Artificial Sequence
  C33B96 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggaggaggcctggtgcagcctggaggaagcctgagactgagctgcgccgcctccggcttcaccttcagcagctactggatgacctgggtgagacctgcccctggaaagggcctggagtgggtggccaacatcaagagggacggcggcgagaagtactacgtggactccgtgaagggcaggttcaccatcagcagggacaacgccgccaactccctgtacctgcagatgaacagcctgagggtggaggacaccgccgtgtactactgcgccaggcccttctacgaccacttcgactactggggccagggcacactggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 79 - DNA, 1810 bp, Artificial Sequence
  C33B101 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggagagcggacctggcctggtgaagcccagcgagaccctgagcctgacctgcacagtgagcggcggcagcatcagcagcagcagctactactggggctggatcaggcagcctcctggcaagggcctggactggatcggcagcatcaactacagcggcagcacctactacaaccccagcctgaagagcagggtgaccatcagcgtggacaccagcaagatccagttcagcctgaagctcagaagcgtgaccgccgccgacacagccgtgtactactgcgccagactggacggctacgagagccccttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 80 - DNA, 1810 bp, Artificial Sequence
  C33B107 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctgctggagagcggcggaggactggtgcagcctggaggaagcctgggcctgagctgtgctgccagcggctttaccttcagcggctacgccatgagctgggtgagacaggcccctggcaagggcctgaactgggtgagcgccatcgactacagcggcaacgacacctactacgccgacagcgtgaagggaaggttcaccatcagcagggacaacagcaagaacaccctgtacctgcagatgaacagcctgagggccgaggacaccgctgtgtactactgcgccaaggagagccagctgctgcacggcctgttcgagcactggggccagggcatcctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 81 - DNA, 1804 bp, Artificial Sequence; identical to SEQ ID NO: 73
  C33B120 heavy chain

SEQ ID NO: 82 - DNA, 1825 bp, Artificial Sequence
  C33B122 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggagagcggacctggcctggtgaagcccagcgagaccctgagcctcacatgcaccgtgagcggcggctccatcaggagcagcagctactactggggctggatcaggcagcctcccggaaaaggccccgagtggatcggcagcatctacagcagcggcaacacctactacaacccctccctcaagagcagggtcaccatcagcgtggacaccagcaagaaccagttcagcctgaagctcatcagcatgaccgccgccgacaccgccgtgttttactgcgccagactggctgccaccatcgtggtgcctgccgccaggtacttcgactgctggggccagggcacactggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 83 - DNA, 1825 bp, Artificial Sequence
  C33B123 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggagagcggacctggcctggtgaagcccagcgagacactgagcctgacctgtaccgtgagcggcggcagcatcagcagcaggagccactactggggctggattaggcagcctcctggagtgggcctggagtggatcggcagcatctactacaccggcagcacctactacaaccccagcctgaagagcagggtgaccatcagcgtggacaccagcaagaaccagttcagcctgaagctgagcagcgtgacagccgccgacacagccgtgtactactgcgccaggctggccgatatcgtggtggtgcctgccgccaggtacttcgattactggggacagggcaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 84 - DNA, 1807 bp, Artificial Sequence
  C33B124 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctgctggagagcggaggaggactggtgcagcctggcggaagcctgaggctgagctgtgccgccagcagattcaccttcagcagctacgccatgacctgggtgagacaggcccctggcaagggactggagtgggtgagcaccatcaacatcagcggcggcagcacctactacgccgacagcgtgaagggcaggttcaccatcagcagggacaacagcaagaacaccctgtacctgcagatgaacagcctgagggccgaggacaccgccgtgtactactgcaccaagggaggctacagcagcggccccttcgactactggggacagggcaccctggtgagcgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 85 - DNA, 1837 bp, Artificial Sequence
  C33B125 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcaactggtggagagcggcggcggagtggtgcaacctggcagaagcctgagactgagctgcgccgccagcggcttcaccttcagcagctacggcatgcactgggtgagacaggcccctggcaaaggcctggaatgggtggccgtgatcagctacgacggcagcaacaagtactacgccgacagcgtgaagggcaggttcaccatcagcagggacaacagcaagaacaccctgtacctgcagatgaacagcctgagggccgaggacaccgccgtgtactactgcgccaaggacttcaggagcttcgactggctgccccccgacagcacctcctactacggcatggacgtgtggggccagggaaccaccgtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 86 - DNA, 1828 bp, Artificial Sequence
  C33B760 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggagagcggaggcggagtggtgcagcctggcagaagcctgagactgagctgcgccgccagcggcttcaccttcagcagctacggcatgcactgggtgaggcagagccctggcaaaggcctggagtgggtggccgtgatcagctacgacggcagcaacaagtactgcgccgacagcgtgaagggcaggttcaccatcagcagggacaacagcaagagcaccctgtacctgcagatgaacagcctgagggccgaggacaccgccgtgtactactgcgccaaggacttcaggagcctggactggctgccccccgatagcaccagctatgacggcatggacgtgtggggacagggcaccaccgtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 87 - DNA, 1828 bp, Artificial Sequence
  C33B777 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggagagcggcggaggagtggtgcagcctggaaggagcctgagactgtcctgcgccgctagcggcttcaccttcagcagctacggcatgcactgggtgagacaggctcccggcaagggactggagtgggtggtggtgatcagctacgacggcagcaacaagtactacgccgacagcgtgaagggcaggttcaccatcagcagggacaacagcaagaacaccctgtacctgcagatgaacagcctgagggccgaggacaccgccgtgtactactgcgccaaggacttcagggacttcgactggctgcctcctgatagcaccagctaccacggcatggacgtgtggggccagggaaccaccgtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 88 - DNA, 1828 bp, Artificial Sequence
  C33B778 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggaaagcggcggaggcgtggtgcagcctggaagaagcctgagactgagctgcgtggccagcggcttcacctttagcagctacggcatgcactgggtgaggcaggctcctggcaagggactggagtgggtggccgtgatcagctacgacggcagcaacaagtactacgccgacagcgtgaagggcaggttcaccatcagcagggacaacagcaagaacaccctgtacctgcagatgaacagcctgagagccgagggcaccgccgtgtactactgcgccaaggacttcaggagctttgattggctgccccctgatagcgccagctaccacggcatggacgtgtggggccagggcacaaccgtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 89 - DNA, 1795 bp, Artificial Sequence
  C33B782 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggaggaggactggtgcagcctggaggcagcctgagactgagctgcgccgctagcggcttcaccttcagcagctactggatgagctgggtgagacaggcccctggcaagggactggagtgggtggccaacatcaagcagcacggcagcgagaagtactacgtggatagcgtgaagggcaggttcaccatcagcagggacaacgccaaaaacagcctgtacctgcagatgaacagcctgagggccgaggacaccgccgtgtattactgcgccagggacagggacctgggctacttcgactactggggccagggcaccctggtgacagtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 90 - DNA, 1795 bp, Artificial Sequence
  C33B792 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggcggaggattcgtgcagcccggaggaagcctgagactgagctgcgccgccagcggcttcaccttcagctcctactggatgagctgggtgagacaggctcccggcaagggactggagtgggtggccaacatcaagcagcacggcagcgagaagtactacgtggacagcgtgaagggcaggttcaccatcagcagggacaacgtgaagaacagcctgtacctgcagatgaacagcctgaggaccgaggacaccgccgtgtactactgcgccagggacagggacctgggctacttcgactactggggccagggaaccctggtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 91 - DNA, 1795 bp, Artificial Sequence
  C33B799 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggaggcggatttgtgcagcctggcggcagcctgagactgagctgtgccgccagcggcttcaccttcagcagctactggatgagctgggtgaggcaggcccctggaaagggactggagtgggtggccaacatcaagcagcacggaagcgagaagtactacgtggacagcgtgaagggaaggttcacaatcagcagggacaacgccaagaacagcctgtacctgcagatgaacagcctgagggccgaggacaccgccgtgtactactgcgccagggacagggacctgggctacttcgactactggggccagggcaccctggtgacagtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 92 - DNA, 1801 bp, Artificial Sequence
  C33B806 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagctgcagctgcaggagagcggacctggcctggtgaagcccagcgagaccctgagcctgacctgcacagtgagcggcggcagcatcagcagcagcagctactactggggctggatcaggcagcctcctggcaagggcctggactggatcggcagcatcaactacagcggcagcacctactacaaccccagcctgaagagcagggtgaccatcagcgtggacaccagcaagatccagttcagcctgaagctcagaagcgtgaccgccgccgacacagccgtgtactactgcgccagactggacggctacgagagccccttcgactactggggccagggcaccctggtgacagtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 93 - DNA, 1828 bp, Artificial Sequence
  C33B830 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcaactggtggagagcggcggcggagtggtgcaacctggcagaagcctgagactgagctgcgccgccagcggcttcaccttcagcagctacggcatgcactgggtgagacaggcccctggcaaaggcctggaatgggtggccgtgatcagctacgacggcagcaacaagtactacgccgacagcgtgaagggcaggttcaccatcagcagggacaacagcaagaacaccctgtacctgcagatgaacagcctgagggccgaggacaccgccgtgtactactgcgccaaggacttcaggagcttcgactggctgccccccgacagcacctcctactacggcatggacgtgtggggccagggaaccaccgtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 94 - DNA, 1792 bp, Artificial Sequence
  C33B836 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtgcagagcggaagcgagctgagaaagcccggcgccagcgtgaaggtgagctgcaaggccagcggctacaccttcaccaactacgccatgaactgggtgaggcaggcccctggacaaggcctggagtggatgggctggatcaacaccaacaccggcaaccccacctacgcccagggctttaccggcaggttcgtgttcagcctggacaccagcgtgagcagcgcctacctgcagatcagcagcctgaaggccgaggacaccgccatgtactactgcgccaccgacagggacaggggaaccgactactggggccagggcacactggtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 95 - DNA, 1828 bp, Artificial Sequence; identical to SEQ ID NO: 88
  C33B937 heavy chain

SEQ ID NO: 96 - protein, 217 aa, Artificial Sequence
  C33B46 light chain
QSALTQPASVSGSPGQSITISCTGTSSDVGDDNYVSWYQQHPGKAPKLMIYDVSNRPSGVSNRFSGSKSGNTASLTISGLQSEDEADYYCSSYSSSTTLEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 97 - protein, 217 aa, Artificial Sequence
  C33B48 light chain
QSALTQPASVSGSPGQSITISCTGTSSDVGDYNYVSWYQQHPGKVPKLMIYDVSNRPSGVSNRFSGSMSGNTASLTISGLQAEDEADYYCSSYSSSSALEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 98 - protein, 212 aa, Artificial Sequence
  C33B52 light chain
SYELTQPPSVSVSPGQTASIICSGDKLGNKYACWYQQKPGQSPVLVIYQDSKRPSGIPERFSGSNSGNTATLTISGTQAVDEADYYCQAWDSSTYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 99 - protein, 213 aa, Artificial Sequence
  C33B54 light chain
SYVLTQPPSVSVAPGQTARITCGGSNIGSKSVHWYQQKPGQAPVMVVYDDSDRPSGIPERFSGSNSGNTATLTISRVEAGDEADYYCQVWDSSSDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 100 - protein, 212 aa, Artificial Sequence
  C33B55 light chain
SYELTQPPSVSVSPGQTASITCSGHKLGDKYACWYQQKPGQSPVVVIYKDSKRPSGIPERFSGSNFGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 101 - protein, 212 aa, Artificial Sequence
  C33B56 light chain
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 102 - protein, 212 aa, Artificial Sequence
  C33B61 light chain
SYELTQPPSVSVSPGQTASITCSGDKLGDKYACWYQQKPGQSPVLVIYQDYKRPSGIPERFSGSNSGNTATLTISGTQAMDEADYYCQAWDSSTYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 103 - protein, 212 aa, Artificial Sequence
  C33B62 light chain
SYELTQPPSVSVSPGQTASITCSGDKLGDKYACWYQQKPGQSPVLVIYQDYKRPSGIPERFSGSNSGNTATLTISGTQTMDEADYYCQAWDISTYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 104 - protein, 212 aa, Artificial Sequence
  C33B63 light chain
SYELTQPPSVSVSPGQTASITCSGDKLGDKYACWYQLRPGQSPILVIYQDSNRPSGIPERFSGSNSGNTATLTISGTQAMDEADYYCQAWDSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 105 - protein, 212 aa, Artificial Sequence
  C33B64 light chain
SYELTQPPSVSVSPGQTASITCSGDKLGDKYACWYQQKPGQSPVLVIYQDSKRPSGIPERFSGSNSGNTATLTISGTQAMDEADYYCQAWDSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 106 - protein, 214 aa, Artificial Sequence
  C33B66 light chain
SYVLTQPPSVSVAPGQTARITCGGNNIGIKSVHWYQQKPGQAPVLVVYDDSDRPPGIPERFSGSNSGNTATLTITRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 107 - protein, 212 aa, Artificial Sequence
  C33B72 light chain
SYELTQPPSVSVSPGQTASITCSGDKLGDKYACWYQQKPGQSPVVVIYQDRKRPSGIPERFSGSNFGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 108 - protein, 212 aa, Artificial Sequence
  C33B73 light chain
SYELTQPPSVSVSPGQTASITCSGDKLGDKYACWYQQKPGQSPVLVIYQDGKRPSGIPERFSGSNFGNKATLTISGTQAMDEADYYCQAWDRNTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 109 - protein, 212 aa, Artificial Sequence; identical to SEQ ID NO: 105
  C33B75 light chain

SEQ ID NO: 110 - protein, 212 aa, Artificial Sequence
  C33B77 light chain
SYELTQPPSVSVSPGQTASITCSGNKLGAKFASWYQQKPGQSPVLVIYQDNKRPSGIPERFSGSNSGNTATLTISGTQAVDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 111 - protein, 212 aa, Artificial Sequence
  C33B79 light chain
SYELTQPPSVSVPPGQTASITCSGDKLGDKYACWYQQKPGQSPVLVIYQDNKRPSGIPERFSGSNSGNTATLTISGTQAMDEADYYCQAWGRNTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 112 - protein, 217 aa, Artificial Sequence
  C33B80 light chain
QSALTQPASVSGSPGQSIPISSTGTSSDDGKNNIVSWYQQHPGKAPKLMIYKDSKRPSGVSNRFSGSKSGNTASLTISGLQADDEADYHCCSYAGASNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 113 - protein, 212 aa, Artificial Sequence
  C33B82 light chain
SYELTQPPSVSVSPGQTASITCSGDELGNKYACWYQQKPGQSPVVVVYQDRKRPSGIPERFSGSNFGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 114 - protein, 212 aa, Artificial Sequence
  C33B83 light chain
SYELTQPPSVSVSPGQTASITCSGDKLGDKYACWYQQKPGQSPVLVIYQDNKRPSGIPERFSGSNSGNTATLTISGTQAMDEADYYCQAWDSNTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 115 - protein, 212 aa, Artificial Sequence
  C33B87 light chain
SYELTQPPSVSVSPGQTASITCSGDKLGNKYASWYQQKPGQSPVLVIYQDTKRPSGIPERVSGSNSGNTATLTISGTQAMDEADYHCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 116 - protein, 217 aa, Artificial Sequence
  C33B88 light chain
QSALTQPASVSGSPGQSITISCTGINSDVGSYDLVSWYQQHPGKAPKLLIYDGSERPSGVFGRFSGSKSDNTTSLTISGLQAEDEAAYYCCSYEVTTTYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 117 - protein, 214 aa, Artificial Sequence
  C33B89 light chain
SYVLTQPPSVSVAPGQTARITCGGNNIGSKSVHWSQQKPGQAPVLVVYDDSDRPSGIPERFSGSNSGNTATLTISRVEAGDEADYYCQVWDSNSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 118 - protein, 212 aa, Artificial Sequence
  C33B94 light chain
SYELTQPPSVSVSPGQTASITCSGDKLGSKFACWYQQKPGQSPVLVIYQDSKRPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 119 - protein, 212 aa, Artificial Sequence; identical to SEQ ID NO: 101
  C33B95 light chain

SEQ ID NO: 120 - protein, 214 aa, Artificial Sequence
  C33B96 light chain
SYVLTQPPSVAVAPGQTARITCGGSNIGKISVHWYQQKAGQAPVLVVHDDRARPSGIPERLSGSNSGTTATLTISRVEVGDEADYYCQVWNSSSVHPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 121 - protein, 214 aa, Artificial Sequence
  C33B101 light chain
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 220 aa, Artificial Sequence
  C33B107 light chain
DIVMTQSPDSLAVSLGERATINCKSSQSVLYSSNNKNYLAWYQQKAGQPPKLLIYWASTRESGVPDRFSGSGSGTDFILIISSLQAEDVAVYYCQQYYGTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 123 - protein, 212 aa, Artificial Sequence
  C33B120 light chain
SYELTQPPSVSVSPGQTASITCSGDKLGNKYASWYQQKPGQSPVLVIYQDSKRPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 124 - protein, 212 aa, Artificial Sequence
  C33B122 light chain
SYELTQPPSVSVSPGQTVSISCSGDRLGDKYACWYQQKPGQSPVLVIYQDSKRPSGIPERFSGSNSGNTATLTISGTQAMDEADYYCQAWDSSSYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 125 - protein, 212 aa, Artificial Sequence
  C33B123 light chain
SYELTQPPSVSVSPGQTASITCSGDKLGDKYACWYQQKPGQSPVLVIYQDSNRPSGIPERFSGSNSGNTATLTISETQAMDEADYYCQAWDSSTYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 126 - protein, 213 aa, Artificial Sequence
  C33B124 light chain
SYELTQPPSVSVSPGQTASITCSGDKLGDKYVRWYQQKTGQSPVLVMYQDSKRPSGIRERFYGSNSGNTATPTISGTQAVDEAEYYCQAWDSSTGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 127 - protein, 212 aa, Artificial Sequence
  C33B125 light chain
SYELTQPPSVSVSPGQTASITCSGDKLGDKYVCWYQQKPGQSPVVVIHQDRKRPSGIPERFSGSNFGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 128 - protein, 212 aa, Artificial Sequence; identical to SEQ ID NO: 100
  C33B760 light chain

SEQ ID NO: 129 - protein, 212 aa, Artificial Sequence; identical to SEQ ID NO: 107
  C33B777 light chain

SEQ ID NO: 130 - protein, 212 aa, Artificial Sequence; identical to SEQ ID NO: 108
  C33B778 light chain

SEQ ID NO: 131 - protein, 212 aa, Artificial Sequence; identical to SEQ ID NO: 110
  C33B782 light chain

SEQ ID NO: 132 - protein, 212 aa, Artificial Sequence; identical to SEQ ID NO: 115
  C33B792 light chain

SEQ ID NO: 133 - protein, 212 aa, Artificial Sequence; identical to SEQ ID NO: 118
  C33B799 light chain

SEQ ID NO: 134 - protein, 214 aa, Artificial Sequence; identical to SEQ ID NO: 121
  C33B806 light chain

SEQ ID NO: 135 - protein, 212 aa, Artificial Sequence; identical to SEQ ID NO: 127
  C33B830 light chain

SEQ ID NO: 136 - protein, 217 aa, Artificial Sequence; identical to SEQ ID NO: 97
  C33B836 light chain

SEQ ID NO: 137 - protein, 212 aa, Artificial Sequence
  C33B937 light chain
SYELTQPPSVSVSPGQTASITCSGDKLGDKYASWYQQKPGQSPVLVIYQDGKRPSGIPERFSGSNFGNKATLTISGTQAMDEADYYCQAWDRNTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 138 - DNA, 1111 bp, Artificial Sequence
  C33B46 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagagcgccctgacacaacctgccagcgtgagcggctcccctggacagagcatcaccatcagctgcaccggcaccagcagcgatgtgggcgacgacaactacgtgagctggtaccagcagcaccctggcaaggcccccaagctgatgatctacgatgtgagcaacaggcccagcggcgtgagcaataggttcagcggcagcaagagcggcaacaccgcttccctgaccatcagcggcctgcagagcgaggatgaggccgactactactgctcctcctacagcagcagcaccaccctggaggtgtttggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 139 - DNA, 1111 bp, Artificial Sequence
  C33B48 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagagcgccctgacacagcctgctagcgtgagcggcagccctggacagtccatcaccatcagctgcaccggcaccagcagcgatgtgggcgactacaactacgtgagctggtaccagcagcaccccggcaaggtgcccaagctgatgatctacgatgtgagcaacaggcccagcggcgtgagcaataggttcagcggcagcatgagcggcaacaccgccagcctgaccatttccggcctgcaggccgaggacgaagccgactactactgctccagctacagcagcagcagcgccctggaagtgtttggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 140 - DNA, 1096 bp, Artificial Sequence
  C33B52 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctccttccgtgagcgtgagccctggccagacagccagcatcatctgcagcggcgataagctgggcaacaagtacgcctgctggtaccagcagaagcccggccaaagccccgtgctggtgatctaccaggacagcaagagacccagcggcatccccgagaggttcagcggctccaatagcggcaacaccgccaccctgaccattagcggcacccaggccgtggatgaggccgactactactgccaggcctgggacagcagcacctacgtgttcggcaccggcaccaaggtgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 141 - DNA, 1099 bp, Artificial Sequence
  C33B54 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgtgctgacccagcctcctagcgtgagcgtggctcctggacagaccgccaggatcacatgcggcggctccaacatcggcagcaagagcgtgcactggtaccagcagaagcccggacaggcccccgtgatggtggtgtacgacgactccgacaggccctccggcattcccgagagattcagcggcagcaacagcggcaacaccgccaccctgaccatcagcagagtggaggccggcgatgaggccgactactactgccaggtgtgggatagcagcagcgacgtggtgtttggcggcggcacaaaactgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 142 - DNA, 1096 bp, Artificial Sequence
  C33B55 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagaccgctagcatcacctgcagcggccacaagctgggcgacaagtacgcctgctggtaccagcagaaacccggccagagccccgtggtggtgatctacaaggacagcaagagacccagcggcatccccgagaggttcagcggcagcaacttcggcaacaccgccaccctgaccatcagcggcacacaggccatggacgaggccgactactactgccaggcctgggacagcagcacagtggtgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 143 - DNA, 1096 bp, Artificial Sequence
  C33B56 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagacagccagcatcacctgcagcggcgacaagctgggcgacaagtacgcctgctggtaccagcagaaacccggccagagccccgtgctggtgatctaccaggacagcaagagacccagcggcatccccgagaggttcagcggcagcaacagcggcaacaccgccaccctgacaatcagcggcacacaggccatggacgaggccgactactactgccaggcctgggacagcagcaccgtggtgttcggcggaggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 144 - DNA, 1096 bp, Artificial Sequence
  C33B61 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcctcctacgagctgacccagcctcctagcgtgagcgtgagccctggacagaccgccagcatcacctgcagcggcgacaagctgggcgacaagtacgcctgctggtaccagcagaaacccggccagagccccgtgctggtgatctaccaggactacaagaggcccagcggcatccctgagaggttcagcggcagcaactccggcaacaccgccaccctgaccatctccggcacacaggccatggacgaggccgactactactgccaggcctgggacagcagcacctacgtgttcggcaccggcaccaaggtgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 145 - DNA, 1096 bp, Artificial Sequence
  C33B62 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagacagccagcatcacctgcagcggcgacaagctgggcgacaagtatgcctgctggtaccagcagaaacccggccagagccccgtgctggtgatctaccaggactacaaaaggcccagcggcatccccgagagattcagcggcagcaacagcggcaacaccgccaccctgaccatcagcggcacccagaccatggacgaggccgactactactgccaggcctgggacatcagcacctacgtgttcggcaccggcaccaaggtgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 146 - DNA, 1096 bp, Artificial Sequence
  C33B63 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagacagccagcatcacctgcagcggcgacaagctgggcgacaagtacgcctgctggtaccagctgagacccggccagagccccatcctggtgatctaccaggacagcaacaggcccagcggcatccccgagagattcagcggcagcaacagcggcaacaccgccaccctgaccatcagcggaacccaggccatggacgaggccgactactactgccaggcctgggacagcagcacctgggtgttcggaggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 147 - DNA, 1096 bp, Artificial Sequence
  C33B64 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggacagaccgccagcatcacctgcagcggcgacaagctgggcgacaagtacgcctgctggtaccagcagaagcccggacagagccccgtgctggtgatctaccaggacagcaagagacccagcggcatccccgagaggttcagcggcagcaacagcggcaacaccgccacactgaccatcagcggcacccaggccatggatgaggccgactactactgccaggcctgggacagcagcacctgggtgtttggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 148 - DNA, 1102 bp, Artificial Sequence
  C33B66 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgtcctgacacagcctcccagcgtgagcgtggctcctggacagaccgccaggatcacctgcggcggcaacaacatcggcatcaagagcgtgcactggtaccagcagaagcccggccaggctcctgtgctggtggtgtacgacgacagcgacagaccccccggcatccctgagaggttcagcggcagcaacagcggcaacaccgccaccctgaccatcacaagagtggaggccggcgacgaggccgactactactgccaggtgtgggacagcagcagcgatcacgtggtgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 149 - DNA, 1096 bp, Artificial Sequence
  C33B72 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagaccgctagcatcacctgcagcggcgacaagctgggcgacaagtacgcctgctggtaccagcagaagcccggccagagccctgtggtggtgatctaccaggacaggaagaggcccagcggcatccccgagagattcagcggcagcaacttcggcaacaccgccaccctgaccatcagcggcacacaggccatggacgaggccgactactactgccaggcctgggacagcagcaccgtggtgtttggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 150 - DNA, 1096 bp, Artificial Sequence
  C33B73 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcctcctacgagctgacccagcctcctagcgtgagcgtgagccctggacagaccgccagcatcacctgcagcggcgacaagctgggcgacaagtacgcctgctggtaccagcagaagcccggacagagccccgtgctggtgatctaccaggacggcaaaaggcccagcggcatccccgagaggtttagcggcagcaacttcggcaacaaggccaccctgaccattagcggcacccaggccatggacgaggccgactactactgccaggcctgggataggaacaccgtggtgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 151 - DNA, 1096 bp, Artificial Sequence; identical to SEQ ID NO: 147
  C33B75 light chain

SEQ ID NO: 152 - DNA, 1096 bp, Artificial Sequence
  C33B77 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagacagccagcatcacctgcagcggcaacaagctgggcgccaagttcgccagctggtaccagcagaagcctggccagagccccgtgctggtgatctaccaggacaacaagaggcccagcggcatccccgagagattcagcggcagcaacagcggcaacaccgccaccctgaccattagcggcacccaggccgtggatgaggccgactactactgccaggcctgggactccagcaccgtggtgtttggcggcggcaccaagctcaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 153 - DNA, 1096 bp, Artificial Sequence
  C33B79 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctccttccgtgagcgtgcctcctggacagacagccagcatcacctgcagcggcgataagctgggcgacaagtacgcctgctggtaccagcagaagcccggccagagccctgtgctggtgatctaccaggacaacaagaggcccagcggcatccccgagagattcagcggcagcaacagcggcaacaccgccaccctgacaatcagcggcacacaggccatggacgaggccgactactactgccaggcctggggcaggaataccgtggtgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 154 - DNA, 1111 bp, Artificial Sequence
  C33B80 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagagcgccctgacacagcctgctagcgtgagcggaagccccggacagagcatccccatcagcagcaccggcacaagcagcgacgacggcaagaacaacatcgtgtcctggtaccagcagcaccctggcaaggcccccaagctgatgatctacaaggacagcaagaggcccagcggcgtgagcaacaggttcagcggcagcaagagcggcaacaccgccagcctgaccattagcggcctgcaggccgacgatgaggccgactaccactgctgcagctacgccggcgctagcaaccacgtggtgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 155 - DNA, 1096 bp, Artificial Sequence
  C33B82 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagaccgctagcatcacctgcagcggcgacgagctgggcaacaagtacgcctgctggtaccagcagaagcccggacagtcccccgtggtggtggtgtaccaggacagaaagagacccagcggcatccccgagaggttcagcggcagcaacttcggcaacaccgccaccctgaccatctccggcacacaggccatggacgaggccgactactactgccaggcctgggacagctccaccgtggtgtttggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 156 - DNA, 1096 bp, Artificial Sequence
  C33B83 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctccttccgtgtccgtgagccctggacagaccgccagcatcacctgcagcggcgacaagctgggcgacaagtacgcctgctggtaccagcagaagcctggccagagccccgtgctggtgatctaccaggacaacaagaggcccagcggcatccccgagaggtttagcggcagcaacagcggcaacaccgccacactgaccatcagcggcacccaggccatggatgaggccgactactactgccaggcctgggacagcaacaccgtggtgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 157 - DNA, 1096 bp, Artificial Sequence
  C33B87 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccaaaccgccagcatcacctgcagcggcgacaagctgggcaacaagtacgccagctggtaccagcagaagcccggccagagccctgtgctggtgatctaccaggacaccaagagacccagcggcatccccgagagagtgagcggcagcaacagcggcaacaccgccaccctgaccattagcggcacccaggccatggacgaggccgactaccactgccaggcctgggacagcagcaccgtggtgtttggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 158 - DNA, 1111 bp, Artificial Sequence
  C33B88 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagagcgccctgacccagcctgctagcgtgagcggaagccctggccagagcatcaccatctcctgcaccggcatcaacagcgacgtgggcagctacgacctggtgagctggtaccagcagcaccctggcaaggcccccaagctgctgatctacgacggcagcgagagacccagcggcgtgtttggcaggttcagcggcagcaagagcgacaacaccaccagcctgacaatcagcggcctgcaggccgaggacgaggccgcctactactgctgctcctacgaggtgaccaccacctacgtggtgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 159 - DNA, 1102 bp, Artificial Sequence
  C33B89 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgtgctgacccagcctcctagcgtgagcgtggcccctggacagacagccaggatcacctgtggcggcaacaacatcggcagcaaaagcgtgcactggagccagcagaagcctggccaggcccctgtgctggtggtgtacgacgacagcgacaggcccagcggcatccctgagaggttcagcggctccaacagcggcaacaccgccaccctgaccatcagcagagtggaggccggcgacgaggccgactactactgccaggtgtgggacagcaacagcgaccacgtggtgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 160 - DNA, 1096 bp, Artificial Sequence
  C33B94 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagacagccagcatcacctgcagcggcgacaagctgggctccaagttcgcctgctggtaccagcagaaacccggccagtcccccgtgctggtgatctaccaggacagcaagaggcccagcggcatccctgagaggttcagcggcagcaacagcggcaacaccgctaccctgaccatcagcggcacccaggccatggatgaggccgactactactgccaggcctgggacagcagcaccgtggtgttcggaggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 161 - DNA, 1096 bp, Artificial Sequence; identical to SEQ ID NO: 143
  C33B95 light chain

SEQ ID NO: 162 - DNA, 1102 bp, Artificial Sequence
  C33B96 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgtgctgacacagcccccttccgtggccgtggcccctggccagacagccagaatcacctgcggcggcagcaacatcggcaagatcagcgtgcactggtaccagcagaaagccggccaggcccctgtgctggtggtgcacgatgacagagccaggcccagcggaatccccgagagactgagcggcagcaatagcggcacaaccgccaccctgaccatcagcagagtggaggtgggcgacgaggccgactactactgccaggtgtggaactccagcagcgtgcaccctgtgttcggcggaggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 163 - DNA, 1102 bp, Artificial Sequence
  C33B101 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgacatccagatgacccagagccctagcagcgtgagcgccagcgtgggcgatagggtgaccatcacctgcagggccagccagggcattagcagctggctggcctggtaccagcagaagcccggcaaggcccccaagctgctgatctacgccgccagcagcctgcagagcggcgtgcctagcaggttctccggatccggcagcggcaccgacttcaccctgaccatcagcagcctgcagcccgaggacttcgccacctactactgccagcaggccaacagcttccccttcaccttcggccccggcaccaaggtggacatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 164 - DNA, 1120 bp, Artificial Sequence
  C33B107 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgacatcgtgatgacccagagccctgattccctggccgtgagcctgggagagagagccaccatcaactgcaagagcagccagagcgtgctgtacagcagcaataacaagaactacctggcctggtaccagcagaaggccggccagcctcccaagctgctgatctactgggccagcaccagagagagcggcgtgcctgacaggtttagcggcagcggcagcggcaccgacttcatcctgatcatcagcagcctgcaggccgaggatgtggccgtgtactactgccagcagtactacggcaccccctggaccttcggccagggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 165 - DNA, 1096 bp, Artificial Sequence
  C33B120 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggacagaccgccagcatcacctgcagcggcgacaagctgggcaacaagtacgccagctggtaccagcagaagcccggccagagccctgtgctggtgatctaccaggacagcaagaggcccagcggcatccccgagagattcagcggcagcaacagcggcaacaccgccacactgaccatcagcggcacccaggccatggatgaggccgactactactgccaggcctgggacagcagcaccgtggtgtttggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 166 - DNA, 1096 bp, Artificial Sequence
  C33B122 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagaccgtgagcatcagctgcagcggcgacaggctgggcgacaagtatgcctgctggtaccagcagaagcccggccagagccctgtgctggtgatctaccaggacagcaagaggcccagcggcatccctgagaggttcagcggcagcaacagcggcaacaccgccaccctgaccatcagcggcacacaggccatggacgaggccgactactactgccaggcctgggacagcagcagctacgtgttcggcaccggcaccaaggtgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 167 - DNA, 1096 bp, Artificial Sequence
  C33B123 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagccccctagcgtgagcgtgagccctggacagaccgccagcatcacctgcagcggcgacaagctgggcgacaagtacgcctgctggtaccagcagaagcccggacagagccccgtgctggtgatctaccaggacagcaacaggcccagcggcatccctgagaggttcagcggcagcaacagcggcaacaccgccacactgaccatcagcgagacccaggccatggacgaggccgactactactgccaggcctgggacagcagcacctacgtgttcggcaccggcaccaaggtgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 168 - DNA, 1099 bp, Artificial Sequence
  C33B124 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctccttccgtgagcgtgagccctggccagacagccagcatcacctgcagcggcgacaagctgggcgacaagtacgtgaggtggtaccagcagaagaccggccagagccccgtgctggtgatgtaccaggacagcaagaggcccagcggcatcagggagaggttttacggctccaacagcggcaacaccgccacacccaccatcagcggaacccaggccgtggatgaggccgagtactactgccaggcctgggacagcagcacaggcgtggtgtttggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 169 - DNA, 1096 bp, Artificial Sequence
  C33B125 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccccggacagacagccagcatcacctgcagcggcgacaagctgggcgacaagtacgtgtgctggtaccagcagaagcccggacagagccccgtggtggtgatccaccaggacaggaagaggcccagcggcatccccgagagattcagcggcagcaacttcggcaacaccgccaccctgaccatcagcggcacccaggccatggatgaggccgactactactgccaggcctgggacagcagcaccgtggtgttcggaggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 170 - DNA, 1096 bp, Artificial Sequence; identical to SEQ ID NO: 142
  C33B760 light chain

SEQ ID NO: 171 - DNA, 1096 bp, Artificial Sequence; identical to SEQ ID NO: 149
  C33B777 light chain

SEQ ID NO: 172 - DNA, 1096 bp, Artificial Sequence; identical to SEQ ID NO: 150
  C33B778 light chain

SEQ ID NO: 173 - DNA, 1096 bp, Artificial Sequence; identical to SEQ ID NO: 152
  C33B782 light chain

SEQ ID NO: 174 - DNA, 1096 bp, Artificial Sequence; identical to SEQ ID NO: 157
  C33B792 light chain

SEQ ID NO: 175 - DNA, 1096 bp, Artificial Sequence; identical to SEQ ID NO: 160
  C33B799 light chain

SEQ ID NO: 176 - DNA, 1102 bp, Artificial Sequence; identical to SEQ ID NO: 163
  C33B806 light chain

SEQ ID NO: 177 - DNA, 1096 bp, Artificial Sequence; identical to SEQ ID NO: 169
  C33B830 light chain

SEQ ID NO: 178 - DNA, 1111 bp, Artificial Sequence; identical to SEQ ID NO: 139
  C33B836 light chain

SEQ ID NO: 179 - DNA, 1096 bp, Artificial Sequence
  C33B937 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagccccctagcgtgagcgtgagccctggacagaccgccagcatcacctgcagcggcgacaagctgggcgacaagtacgccagctggtaccagcagaagcccggccagagccctgtgctggtgatctaccaggacggcaagaggcccagcggcattcccgagaggttcagcggcagcaacttcggcaacaaggccaccctgaccatcagcggcacccaggccatggatgaggccgactactactgccaggcctgggacaggaacaccgtggtcttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 180 - protein, 446 aa, Artificial Sequence
  C33B901 heavy chain
EVQLVESGGGLVQPGRSLRLSCVASGFTFDDYAIHWVRQAPGKGLEWVSGLSWNGGNIGYADSVKGRFTISRDNAKNSLYLQMNSLKTEDTAFYYCTKDTPYGDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 181 - protein, 446 aa, Artificial Sequence
  C33B902 heavy chain
EVQLVESGGGLVQPGRSLRLSCAGSGFTFDDYAIHWVRQAPGKGLEWVSGLSWNGGNIGYADSVKGRFTISRDNAKNSLYLQLNSLKTEDTAFYYCAKDSPYGDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 182 - protein, 446 aa, Artificial Sequence
  C33B903 heavy chain
EVQLVESGGGLVQPGRSLRLSCAASGFTFDDYAMHWVRQAPGKGLEWVSGIGWSGGSIVYADSVKGRFKISRDNAKNSLYLQMNSLRAEDTALYYCAKDSPYGDFFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 183 - protein, 446 aa, Artificial Sequence
  C33B904 heavy chain
EVQLVESGGGLVQPGRSLRLSCAASGFTFDDYAMHWVRQAPGKGLEWVSGIGWSGGSIVYADSVKGRFTISRDNAKNSLYLQMNSLRAEDTALYYCAKDSPYGDFFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 184 - protein, 446 aa, Artificial Sequence; identical to SEQ ID NO: 183
  C33B905 heavy chain

SEQ ID NO: 185 - protein, 447 aa, Artificial Sequence
  C33B906 heavy chain
EVQLLESGGGLVQPGGSLKLSCTASGFTFRSYAMSWVRQAPGKGLEWVSAINGYGDGRYYADSVKGRFTISRDNSKNTLYLQMNSLRAEDTAVYSCAKDQGFGELFFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 186 - protein, 444 aa, Artificial Sequence
  C33B907 heavy chain
QVQLVESGGGVVQPGRSLRLSCAASGFTFSYYGMHWVRQAPDKGLEWVAVIWFDGNNKYYADSVKGRFTISRDNSKNTLYLQMNSLRAEDTAVYYCARDRELLFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 187 - protein, 456 aa, Artificial Sequence
  C33B908 heavy chain
EVQLVESGGGLVQPGRSLRLSCAASGFTFDDYAMHWVRQVPGEGLEWVSGISWNGGDMVYADSVKGRFTISRDNAKNSLYLQMNSLRPEDTALYYCVKDMPYFDFLTGSDYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 188 - protein, 444 aa, Artificial Sequence
  C33B909 heavy chain
QVQLVESGGGVVQPGRSLRLSCATSGFTFSNYGMHWVRQAPGKGLEWVAVIWYVGSHKYYADSVKGRFTISRDNSKNTLYLQMNSLRAEDTAVYYCARDGSLCFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 189 - protein, 449 aa, Artificial Sequence
  C33B910 heavy chain
EVQLVESGGGLVQPGRSLRLSCVASGFTFDDYAIHWVRQAPGKGLEWVSGLSWNGGNIGYADSVKGRFTISRDNAKNSLYLQMNSLKTEDTAFYYCTKDTPYGDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 190 - protein, 449 aa, Artificial Sequence
  C33B911 heavy chain
EVQLVESGGGLVQPGRSLRLSCAGSGFTFDDYAIHWVRQAPGKGLEWVSGLSWNGGNIGYADSVKGRFTISRDNAKNSLYLQLNSLKTEDTAFYYCAKDSPYGDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 191 - protein, 449 aa, Artificial Sequence
  C33B912 heavy chain
EVQLVESGGGLVQPGRSLRLSCAASGFTFDDYAMHWVRQAPGKGLEWVSGIGWSGGSIVYADSVKGRFKISRDNAKNSLYLQMNSLRAEDTALYYCAKDSPYGDFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 192 - protein, 449 aa, Artificial Sequence
  C33B913 heavy chain
EVQLVESGGGLVQPGRSLRLSCAASGFTFDDYAMHWVRQAPGKGLEWVSGIGWSGGSIVYADSVKGRFTISRDNAKNSLYLQMNSLRAEDTALYYCAKDSPYGDFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 193 - protein, 450 aa, Artificial Sequence
  C33B914 heavy chain
EVQLLESGGGLVQPGGSLKLSCTASGFTFRSYAMSWVRQAPGKGLEWVSAINGYGDGRYYADSVKGRFTISRDNSKNTLYLQMNSLRAEDTAVYSCAKDQGFGELFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 194 - protein, 447 aa, Artificial Sequence
  C33B915 heavy chain
QVQLVESGGGVVQPGRSLRLSCAASGFTFSYYGMHWVRQAPDKGLEWVAVIWFDGNNKYYADSVKGRFTISRDNSKNTLYLQMNSLRAEDTAVYYCARDRELLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 195 - protein, 459 aa, Artificial Sequence
  C33B916 heavy chain
EVQLVESGGGLVQPGRSLRLSCAASGFTFDDYAMHWVRQVPGEGLEWVSGISWNGGDMVYADSVKGRFTISRDNAKNSLYLQMNSLRPEDTALYYCVKDMPYFDFLTGSDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 196 - DNA, 1798 bp, Artificial Sequence
  C33B901 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagtccggaggaggcctggtgcagcctggaaggtccctgagactgtcctgcgtggccagcggcttcaccttcgacgactacgccatccactgggtgagacaggcccctggcaaaggcctggagtgggtgagcggcctgagctggaatggcggcaacatcggctacgccgacagcgtgaagggcaggttcaccatcagcagggacaacgccaagaacagcctgtacctccagatgaacagcctgaagaccgaggacaccgccttctactactgcaccaaggataccccctacggcgactacttcgactactggggccagggcaccctggtgacagtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 197 - DNA, 1798 bp, Artificial Sequence
  C33B902 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggaggcggactggtgcagcctggaaggagcctgagactgagctgcgccggaagcggcttcaccttcgacgactacgccatccactgggtcagacaggctcctggcaagggcctggagtgggtgagcggactgagctggaacggcggcaacatcggctacgccgacagcgtgaagggcaggttcaccatcagcagggacaacgccaagaacagcctgtacctgcagctgaacagcctgaagaccgaggacaccgccttctactactgcgccaaggacagcccctacggcgactacttcgactactggggccagggcacactggtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 198 - DNA, 1798 bp, Artificial Sequence
  C33B903 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggaaagcggcggcggactggtgcaacctggcagaagcctgagactgagctgcgccgccagcggcttcaccttcgacgactacgccatgcactgggtgagacaggcccctggaaagggcctggagtgggtgagcggcattggctggtccggaggcagcatcgtgtacgccgacagcgtgaagggcaggttcaagatcagcagggacaacgccaagaacagcctgtacctgcagatgaacagcctgagagccgaggacaccgccctgtactactgcgccaaggacagcccctacggcgacttcttcgactactggggccagggcacactggtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 199 - DNA, 1798 bp, Artificial Sequence
  C33B904 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggcggaggactggtgcagcctggcagaagcctgagactgagctgtgccgccagcggcttcacctttgacgactacgccatgcactgggtgagacaggctcctggcaagggcctggagtgggtgagcggcattggatggagcggcggcagcatcgtgtacgccgacagcgtgaagggcaggttcaccattagcagggacaacgccaagaacagcctgtacctgcagatgaacagcctgagggccgaggacaccgccctgtactactgcgccaaggacagcccctacggcgacttcttcgactactggggccagggcaccctggtgacagtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 200 - DNA, 1798 bp, Artificial Sequence
  C33B905 heavy chain
cagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgaagcttgccgccaccatggcttgggtgtggaccttgctattcctgatggcagctgcccaaagtatacaggccgaagtgcagctggtggaatctggcggaggactggttcagcctggcagatctctgagactgtcttgtgccgcctctggcttcaccttcgacgattacgctatgcactgggtccgacaggcccctggaaaaggattggagtgggtgtccggaattggttggagcggcggctctatcgtgtacgccgattctgtgaagggcagattcaccatcagccgggacaacgccaagaactccctgtacctgcagatgaacagcctgagagccgaggacaccgctctgtactactgcgccaaggactctccctacggcgacttctttgattactggggccagggcacactggtcaccgtttcttctgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatgattcgaacccgggcacgtgcggaccgaattcattgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttca

SEQ ID NO: 201 - DNA, 1801 bp, Artificial Sequence
  C33B906 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctgctggagagcggaggaggactggtgcagcccggaggaagcctgaagctgtcctgcaccgccagcggcttcaccttcaggagctacgccatgagctgggtgagacaggcccctggcaagggcctggaatgggtgagcgccatcaacggctacggcgacggcaggtactacgccgacagcgtgaagggcaggttcaccatcagcagggacaacagcaagaacaccctgtacctgcagatgaacagcctgagagccgaggacaccgccgtgtacagctgcgccaaggaccagggcttcggcgagctgttcttcgactactggggccagggcacactggtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 202 - DNA, 1792 bp, Artificial Sequence
  C33B907 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggaaagcggaggcggagtggtgcagcccggaagaagcctgagactgtcctgcgccgccagcggcttcaccttcagctactacggcatgcactgggtgaggcaggcccctgacaagggactggagtgggtggccgtgatctggttcgacggcaacaacaagtactacgccgacagcgtgaagggcaggttcaccatcagcagggacaactccaagaacaccctgtacctgcagatgaacagcctgagggccgaggacaccgccgtgtactactgcgccagggacagggagctgctgttcgactactggggccagggaaccctggtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 203 - DNA, 1828 bp, Artificial Sequence
  C33B908 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtccagctggtggaatccggcggaggactggtgcagcctggcagaagcctgagactgagctgcgccgccagcggcttcaccttcgacgactacgccatgcactgggtgagacaggtgcctggcgagggactggagtgggtgagcggaatcagctggaacggcggcgacatggtgtacgccgacagcgtgaagggcaggttcaccatcagcagggacaacgccaagaacagcctgtacctgcagatgaacagcctgaggcctgaggacaccgccctgtactactgcgtgaaggacatgccctacttcgacttcctgaccggcagcgactactactactacggcatggacgtgtggggccagggcacaaccgtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 204 - DNA, 1792 bp, Artificial Sequence
  C33B909 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggaaagcggaggaggagtggtgcagcctggcaggagcctgaggctgagctgtgccaccagcggcttcaccttcagcaattacggcatgcactgggtgagacaggctcctggcaagggcctggagtgggtggccgtgatctggtacgtgggcagccacaagtactacgccgacagcgtgaagggcaggttcaccatcagcagggacaacagcaagaacaccctgtacctgcagatgaacagcctgagggccgaggacaccgccgtgtactactgcgccagggacggcagcctgtgcttcgactactggggccagggaaccctggtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 205 - DNA, 1807 bp, Artificial Sequence
  C33B910 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagtccggcggaggactggtgcaacctggcaggagcctgagactgagctgcgtggccagcggcttcaccttcgacgactacgccatccactgggtgaggcaggcccctggcaaaggcctggagtgggtgagcggcctgagctggaatggcggcaacatcggctacgccgacagcgtgaagggcaggttcaccatcagcagggacaacgccaagaacagcctgtacctgcagatgaacagcctgaaaaccgaggacaccgccttctactactgcaccaaggacaccccctacggcgactacttcgactactggggccagggaaccctggtgaccgtgagctccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 206 - DNA, 1807 bp, Artificial Sequence
  C33B911 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggaaagcggcggaggactggtgcagcccggcaggagcctgagactgagctgtgccggcagcggcttcaccttcgacgactacgccatccactgggtgagacaggcccctggaaagggcctggagtgggtgagcggactgagctggaacggcggcaacatcggctacgccgacagcgtgaaaggcaggttcaccatcagcagggacaacgccaagaacagcctgtacctgcagctgaacagcctgaagaccgaggataccgccttctactactgcgccaaggacagcccctatggcgactacttcgactactggggccagggcacactggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 207 - DNA, 1807 bp, Artificial Sequence
  C33B912 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggcggaggactggtgcagcctggcagaagcctgagactgagctgcgccgccagcggcttcaccttcgacgactacgccatgcactgggtcagacaggcccccggaaagggactggagtgggtgagcggaatcggctggagcggaggcagcatcgtgtacgccgacagcgtgaagggcaggttcaagatcagcagggacaacgccaagaacagcctgtacctgcagatgaactccctgagagccgaggacaccgccctgtactactgcgccaaggacagcccctacggcgacttcttcgactactggggccagggaaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 208 - DNA, 1807 bp, Artificial Sequence
  C33B913 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggcggaggactggtgcagcctggcagaagcctgaggctgagctgtgccgccagcggcttcaccttcgacgactacgccatgcactgggtgagacaggctcctggcaagggcctggagtgggtgagcggcatcggatggagcggaggcagcatcgtgtacgccgacagcgtgaagggcaggttcaccatcagcagggacaacgccaagaacagcctgtacctgcagatgaactccctgagggccgaggacaccgccctgtactactgcgccaaggacagcccctacggcgacttcttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 209 - DNA, 1810 bp, Artificial Sequence
  C33B914 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctgctggagagcggcggaggactggtgcagcctggaggcagcctgaagctgagctgcaccgccagcggcttcaccttcaggagctacgccatgagctgggtgagacaggctcccggaaagggcctggagtgggtgtccgccatcaacggctacggcgacggcaggtactacgccgacagcgtgaagggcaggttcaccatcagcagggacaactccaagaacaccctgtacctgcagatgaacagcctgagggccgaggataccgccgtgtacagctgcgccaaggaccagggcttcggcgagctgttcttcgactactggggccagggaaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 210 - DNA, 1801 bp, Artificial Sequence
  C33B915 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccaggtgcagctggtggagtccggaggaggagtggtgcagcccggcagaagcctgagactgagctgcgccgccagcggcttcaccttcagctactacggcatgcactgggtgaggcaggcccctgataagggcctggagtgggtggccgtgatctggttcgacggcaacaacaagtactacgccgacagcgtgaagggcaggttcaccatcagcagggacaacagcaagaacaccctgtacctgcagatgaacagcctgagggccgaggacaccgccgtgtactactgcgccagggacagggagctgctgttcgactactggggccagggcacactggtcaccgtgagctccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 211 - DNA, 1837 bp, Artificial Sequence
  C33B916 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgaggtgcagctggtggagagcggaggcggactggtgcagcctggaaggagcctgaggctgagctgtgccgccagcggcttcaccttcgacgactacgccatgcactgggtgagacaggtgcctggcgagggactggagtgggtgagcggcatcagctggaacggcggcgacatggtgtacgccgacagcgtgaagggcaggttcaccatcagcagggacaacgccaagaacagcctgtacctgcagatgaacagcctgaggcccgaggacaccgccctgtactactgcgtgaaggatatgccctacttcgacttcctgaccggcagcgactactactactacggcatggatgtgtggggccagggcaccaccgtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcctgctctacagcaagctcaccgtggacaagagcaggtggcagcaggggaacgtcttctcatgctccgtgatgcatgaggctctgcacaaccactacacgcagaagagcctctccctgtctccgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 212 - protein, 214 aa, Artificial Sequence
  C33B901 light chain
DIQMTQSPSSVWASVGDRVTITCRASQGISSWLAWYQQQPGKAPNLLIYRSSSLQSGVPSRFSGSGSGTDFTLTISSLQPEDFATYYCQQDNSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 213 - protein, 214 aa, Artificial Sequence
  C33B902 light chain
DIQMTQSPSSEWASVGDRVTITCRASQGISSWLAWYQQKPGKAPKLLIYGASSWQSGVPSRFSGSGSGTDFTLTISSLQPEDFATYYCQQDNSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 214 - protein, 220 aa, Artificial Sequence
  C33B903 light chain
DIVMTQSPDSLAVSLGERATINCKSSQTVLYSSNNKNYLAWYQQKPGQPPKLLISWASTRKSGVPDRFSGSGSGTDFTLTVSSLQAEDVAVYYCQHYYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 215 - protein, 220 aa, Artificial Sequence
  C33B904 light chain
DIVMTQSPDSLAVSLGERATINCKSSQTVFYSSNNKNYLAWYQQKPGQPPKLLISWASTRKSGVPDRFSGSGSGTDFTLTVSSLQAEDVAVYYCQHYYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - protein, 220 aa, Artificial Sequence; identical to SEQ ID NO: 215
  C33B905 light chain

SEQ ID NO: 217 - protein, 214 aa, Artificial Sequence
  C33B906 light chain
DIQMTQSPSTLSASVGDRVTITCRASQSISSWLAWYQQKPGKAPKLLIYKASSLESGVPSRFSGSGSGTEFTLTISSLQPDDFATYCCQQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 218 - protein, 212 aa, Artificial Sequence
  C33B907 light chain
SYELTQPPSVSVSPGQTASITCSGDELGDMYACWYQQKPGQSPLVVIYQDSKRPSGIPERFSGSNSGNTATLTISGTQAMDEAAYYCQTWDTRIAVFGGGTNLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 219 - protein, 212 aa, Artificial Sequence
  C33B908 light chain
SYELTQPPSVSVSPGQTASITCSGDNLGNEHVCWYHQKPGQSPVLVIYQNNKRPSGIPERFSGSNSGNTATLSISGTQATDEADYYCQAWDSTTAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 220 - protein, 212 aa, Artificial Sequence
  C33B909 light chain
SYELTQPPSVSVSPGQTANISCSGVTLGYNYAYWYQQKPGQSPILVISQDTQRPSGIPERFSGSNSGNTATLTISGTQAMDEAAYYCQAWDITTVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 221 - protein, 214 aa, Artificial Sequence; identical to SEQ ID NO: 212
  C33B910 light chain

SEQ ID NO: 222 - protein, 214 aa, Artificial Sequence; identical to SEQ ID NO: 213
  C33B911 light chain

SEQ ID NO: 223 - protein, 220 aa, Artificial Sequence; identical to SEQ ID NO: 214
  C33B912 light chain

SEQ ID NO: 224 - protein, 220 aa, Artificial Sequence; identical to SEQ ID NO: 215
  C33B913 light chain

SEQ ID NO: 225 - protein, 214 aa, Artificial Sequence; identical to SEQ ID NO: 217
  C33B914 light chain

SEQ ID NO: 226 - protein, 212 aa, Artificial Sequence; identical to SEQ ID NO: 218
  C33B915 light chain

SEQ ID NO: 227 - protein, 212 aa, Artificial Sequence; identical to SEQ ID NO: 219
  C33B916 light chain

SEQ ID NO: 228 - DNA, 1102 bp, Artificial Sequence
  C33B901 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgacatccagatgacccagagccctagcagcgtgtgggctagcgtgggcgacagggtgaccatcacctgcagggccagccagggcatcagcagctggctggcctggtaccaacagcagcctggcaaggcccccaacctgctgatctacagaagcagcagcctgcagagcggagtgcccagcaggtttagcggaagcggcagcggcaccgacttcaccctgaccatcagcagcctgcagcccgaggacttcgccacctactactgccagcaggacaacagcttcccctacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 229 - DNA, 1102 bp, Artificial Sequence
  C33B902 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgacatccagatgacccagagccctagcagcgagtgggctagcgtgggcgacagggtgaccatcacctgcagagccagccagggcatcagcagctggctggcctggtaccagcagaagcccggcaaggcccccaagctgctgatctacggcgccagcagctggcagagcggagtgcctagcaggttcagcggcagcggaagcggcaccgacttcaccctgaccatcagcagcctgcagcccgaggacttcgccacctactactgccagcaggacaacagcttcccctacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 230 - DNA, 1120 bp, Artificial Sequence
  C33B903 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgacatcgtgatgacccagagccctgatagcctggccgtgagcctgggagagagagccaccatcaactgcaagagcagccagaccgtgctgtacagcagcaacaacaagaactacctggcctggtaccagcagaagcctggccagccccccaagctgctgatcagctgggccagcaccagaaagagcggcgtgcctgacagatttagcggcagcggcagcggcaccgatttcaccctgaccgtgagcagcctgcaggccgaggatgtggccgtgtactactgccagcactactacagcaccccctacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 231 - DNA, 1120 bp, Artificial Sequence
  C33B904 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgacattgtgatgacccagagccctgatagcctggccgtgagcctgggcgagagagccaccatcaactgcaagagcagccagaccgtgttctacagcagcaacaacaagaactacctggcctggtaccagcagaagcctggccagccccccaagctgctgatcagctgggccagcaccagaaagagcggcgtgcctgataggtttagcggcagcggcagcggcaccgatttcaccctgaccgtgagctccctgcaggctgaggacgtggccgtgtactactgccagcactactacagcaccccctacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 232 - DNA, 1129 bp, Artificial Sequence
  C33B905 light chain
cagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgaagcttgccgccaccatggcccggaagagcgccctgctggccctggccctgctgctgctgggcttcggccccgcctgggccgacatcgtgatgacccagtctccagacagcctggctgtgtctctgggcgagagagccaccatcaactgcaagtccagccagaccgtgttctactcctccaacaacaagaactacctggcctggtatcagcagaagcccggacagcctcctaagctgctgatctcttgggcctccaccagaaagtctggcgtgcccgatagattctccggctctggctctggcaccgatttcacactgaccgtttctagcctgcaagccgaggacgtggccgtgtactactgccagcactactacagcaccccttacacctttggccagggcaccaagctggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgagaattcattgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgc

SEQ ID NO: 233 - DNA, 1102 bp, Artificial Sequence
  C33B906 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccgacatccagatgacccagtcccctagcacactgagcgccagcgtgggcgacagggtgaccatcacctgcagggccagccagagcatcagcagctggctggcctggtaccagcagaagcccggcaaggcccccaagctgctgatctacaaggccagcagcctggagagcggcgtgcctagcagattcagcggcagcggaagcggcaccgagttcaccctgaccatcagcagcctgcagcccgacgacttcgccacctactgctgccagcagtacaacagctacccctggaccttcggccagggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 234 - DNA, 1096 bp, Artificial Sequence
  C33B907 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagacagccagcatcacctgctccggcgacgagctgggcgacatgtacgcctgctggtaccagcagaagcccggacagtcccccctggtggtgatctaccaggacagcaagaggcccagcggcatccccgagagattcagcggcagcaactccggcaacaccgccaccctgaccatcagcggaacccaggccatggatgaggccgcctactactgccagacctgggacaccaggatcgccgtgttcggaggcggcaccaacctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 235 - DNA, 1096 bp, Artificial Sequence
  C33B908 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagccccctagcgtgagcgtgagccctggacagaccgcctccatcacctgcagcggcgacaacctgggcaatgagcacgtgtgctggtaccaccagaaacccggccagagccccgtgctggtgatctaccagaacaacaagaggccctccggcatccccgagaggtttagcggcagcaacagcggcaacaccgccaccctgagcatctccggcacacaggccaccgatgaggccgactactactgtcaggcctgggacagcaccaccgccgtgtttggcggcggaaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 236 - DNA, 1096 bp, Artificial Sequence
  C33B909 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggccagctacgagctgacccagcctcctagcgtgagcgtgagccctggccagaccgccaacatcagctgcagcggcgtgaccctgggctacaactacgcctactggtaccagcagaagcccggccagagccccatcctggtgatcagccaggacacccagagacccagcggcatccccgagaggttcagcggctccaacagcggcaacaccgccaccctgaccatcagcggcacacaggccatggatgaggccgcctactactgccaggcctgggacatcaccaccgtgctgttcggcggcggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 237 - DNA, 1102 bp, Artificial Sequence; identical to SEQ ID NO: 228
  C33B910 light chain

SEQ ID NO: 238 - DNA, 1102 bp, Artificial Sequence; identical to SEQ ID NO: 229
  C33B911 light chain

SEQ ID NO: 239 - protein, 1120 aa, Artificial Sequence
  C33B912 light chain
TCTGATAAGAGTCAGAGGTAACTCCCGTTGCGGTGCTGTTAACGGTGGAGGGCAGTGTAGTCTGAGCAGTACTCGTTGCTGCCGCGCGCGCCACCAGACATAATAGCTGACAGACTAACAGACTGTTCCTTTCCATGGGTCTTTTCTGCAGTCACCGTCCTTAGATCCACTAGTCCAGTGTGGTGAAGCTTGCCGCCACCATGGCTTGGGTGTGGACCTTGCTATTCCTGATGGCAGCTGCCCAAAGTATACAGGCCGACATCGTGATGACCCAGAGCCCTGATAGCCTGGCCGTGAGCCTGGGAGAGAGAGCCACCATCAACTGCAAGAGCAGCCAGACCGTGCTGTACAGCAGCAACAACAAGAACTACCTGGCCTGGTACCAGCAGAAGCCTGGCCAGCCCCCCAAGCTGCTGATCAGCTGGGCCAGCACCAGAAAGAGCGGCGTGCCTGACAGATTTAGCGGCAGCGGCAGCGGCACCGATTTCACCCTGACCGTGAGCAGCCTGCAGGCCGAGGATGTGGCCGTGTACTACTGCCAGCACTACTACAGCACCCCCTACACCTTCGGCCAGGGCACCAAGCTGGAGATCAAGCGTACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGTTAGTGATTCGAATTCCTAGAAGACATGATAAGATACATTGATGAGTTTGGACAAACCACAACTAGAATGCAGTGAAAAAAATGCTTTATTTGTGAAATTTGTGATGCTATTGCTTTATTTGTAACCATTATAAGCTGCAATAAACAAGTTAACAACAACAATTGCATTCATTTTATGTTTCAGGTTCAGGGGGAGGTGTGGGA

SEQ ID NO: 240 - DNA, 1120 bp, Artificial Sequence; identical to SEQ ID NO: 231
  C33B913 light chain

SEQ ID NO: 241 - DNA, 1102 bp, Artificial Sequence; identical to SEQ ID NO: 233
  C33B914 light chain

SEQ ID NO: 242 - DNA, 1096 bp, Artificial Sequence; identical to SEQ ID NO: 234
  C33B915 light chain

SEQ ID NO: 243 - DNA, 1096 bp, Artificial Sequence; identical to SEQ ID NO: 235
  C33B916 light chain

SEQ ID NO: 244 - protein, 452 aa, Artificial Sequence
  CD3B219 heavy chain
EVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCARHGNFGNSYVSWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK

SEQ ID NO: 245 - protein, 447 aa, Artificial Sequence
  CD3B376 heavy chain
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK

SEQ ID NO: 246 - protein, 447 aa, Artificial Sequence
  B23B49 heavy chain
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 247 - DNA, 1356 bp, Artificial Sequence
  CD3B219 heavy chain
gaagtgcagctggtggaatctggcggcggactggtgcagcctggcggatctctgagactgagctgtgccgccagcggcttcaccttcaacacctacgccatgaactgggtgcgccaggcccctggcaaaggcctggaatgggtggcccggatcagaagcaagtacaacaattacgccacctactacgccgcctccgtgaagggcagattcaccatcagccgggacgacagcaagaacagcctgtacctgcagatgaactccctgaaaaccgaggacaccgccgtgtactactgcgccagacacggcaacttcggcaacagctatgtgtcttggtttgcctactggggccagggcaccctcgtgaccgtgtcatctgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcctcctctacagcaagctaaccgtggacaagagcaggtggcaggaggggaatgtcttctcatgctccgtgatgcatgaggctctgcacaaccactacacacagaagagcctctccctgtctctgggtaaa

SEQ ID NO: 248 - DNA, 1341 bp, Artificial Sequence
  CD3B376 heavy chain
caggtgcagctgcagcagtctggccctagactcgtgcggccttcccagaccctgtctctgacctgtgccatctccggcgactccgtgttcaacaacaacgccgcctggtcctggatccggcagagcccttctagaggcctggaatggctgggccggacctactaccggtccaagtggctgtacgactacgccgtgtccgtgaagtcccggatcaccgtgaaccctgacacctcccggaaccagttcaccctgcagctgaactccgtgacccctgaggacaccgccctgtactactgcgccagaggctactcctcctccttcgactattggggccagggcaccctcgtgaccgtgtcctctgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcctcctctacagcaagctaaccgtggacaagagcaggtggcaggaggggaatgtcttctcatgctccgtgatgcatgaggctctgcacaaccactacacacagaagagcctctccctgtctctgggtaaa

SEQ ID NO: 249 - DNA, 1801 bp, Artificial Sequence
  B23B49 heavy chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggcttgggtgtggaccttgctattcctgatggcagctgcccaaagtatacaggcccagattaccctgaaggaatccggaccaactctcgtcaaacccacacagacactcacactcacctgtacctttagcggcttttccctgtccacttctggaatgggcgtgtcatggattagacagccccctgggaaggccctcgaatggctggctcacatctactgggacgacgacaaacgctacaatcctagcctcaaatcacgactcactatcactaaggacacctccaaaaatcaggtggtgctcacaatgaccaacatggaccccgtggatactgccacatactactgtgctaggctgtacggcttcacttacggatttgcttactggggccagggcacactggtgaccgtgtctagtgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcctcctctacagcaagctaaccgtggacaagagcaggtggcaggaggggaatgtcttctcatgctccgtgatgcatgaggctctgcacaaccactacacacagaagagcctctccctgtctctgggtaaatgatagttcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 250 - protein, 215 aa, Artificial Sequence
  CD3B219 light chain
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 251 - protein, 216 aa, Artificial Sequence
  CD3B376 light chain
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 252 - protein, 218 aa, Artificial Sequence
  B23B49 light chain
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 253 - DNA, 645 bp, Artificial Sequence
  CD3B219 light chain
cagaccgtcgtgacccaggaacctagcctgaccgtgtctcctggcggcaccgtgaccctgacctgcagatcttctacaggcgccgtgaccaccagcaactacgccaactgggtgcagcagaagccaggccaggctcccagaggactgatcggcggcaccaacaagagagcccctggcacccctgccagattcagcggatctctgctgggaggaaaggccgccctgacactgtctggcgtgcagcctgaagatgaggccgagtactactgcgccctgtggtacagcaacctgtgggtgttcggcggaggcaccaagctgacagtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 254 - DNA, 648 bp, Artificial Sequence
  CD3B376 light chain
cagtctgctctgacccagcctgcctccgtgtctggctctcccggccagtccatcaccatcagctgtaccggcacctcctccaacatcggcacctacaagttcgtgtcctggtatcagcagcaccccgacaaggcccccaaagtgctgctgtacgaggtgtccaagcggccctctggcgtgtcctccagattctccggctccaagtctggcaacaccgcctccctgaccatcagcggactgcaggctgaggaccaggccgactaccactgtgtgtcctacgctggctctggcaccctgctgtttggcggaggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 255 - DNA, 1117 bp, Artificial Sequence
  B23B49 light chain
tctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatccactagtccagtgtggtgaagcttgccgccaccatggagacacattctcaggtctttgtatacatgttgctgtggttgtctggtgtcgagggcgatattgtgatgacccagtcccccgattctctcgctgtctctctgggcgaacgggctacaatcaactgtagggcttcacagtctgtcgactacaacggcatctcttacatgcattggtaccagcagaaacctggacagccaccaaaactcctcatctacgccgcttccaatcctgaatctggcgtgcccgaccgattttccggatccggctctggcaccgactttacactcactattagtagcctccaggccgaggatgtggccgtgtactactgtcagcagatcatcgaggatccttggacatttggacagggaaccaaagtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtgattcgaattcctagaagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggga

SEQ ID NO: 256 - protein, 120 aa, Artificial Sequence
  B23H1 heavy chain variable region
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSS

SEQ ID NO: 257 - protein, 125 aa, Artificial Sequence
  CD3H141 heavy chain variable region
EVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCARHGNFGNSYVSWFAYWGQGTLVTVSS

SEQ ID NO: 258 - protein, 120 aa, Artificial Sequence
  CD3H219 heavy chain variable region
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSS

SEQ ID NO: 259 - protein, 125 aa, Artificial Sequence
  C33H42 heavy chain variable region
QLQLQESGPGLVNPSETLSHTCTVSGGSISSSSHYWGWIRQPPGKGLEWIGKIYYSGNTYYNPSLKSRVTISIDTSKNQFSLKMSSVTAADTAVYYCARLADVVVVPAARYFDSWGQGTLVTVSS

SEQ ID NO: 260 - protein, 122 aa, Artificial Sequence
  C33H44 heavy chain variable region
QVQLQQSGPGLVKPSQTLSLTCAISGDSVSSNSAAWNWIRQSPSRGLEWLGRTYYRSKWYNDYAVSVRSRITINPDTSKNQFSLQLNSVTPEDTAVYHCARETMFRGLMDYWGQGTLVTVSS

SEQ ID NO: 261 - protein, 129 aa, Artificial Sequence
  C33H45 heavy chain variable region
QVQLVESGGGVVQPGRSLRLSCAASGFTFSSYGMHWVRQSPGKGLEWVAVISYDGSNKYCADSVKGRFTISRDNSKSTLYLQMNSLRAEDTAVYYCAKDFRSLDWLPPDSTSYDGMDVWGQGTTVTVSS

SEQ ID NO: 262 - protein, 116 aa, Artificial Sequence
  C33H46 heavy chain variable region
QVQLVQSGSELKKPGASVKVSCKASGYTFTNYAMNWVRQAPGQGLEWMGWINTNTGNPTYAQAFTGRFVFSLDTSVSTAYLQISSLKAEDTAVYYCARDREVRDYWGQGTLVTVSS

SEQ ID NO: 263 - protein, 125 aa, Artificial Sequence
  C33H48 heavy chain variable region
QLQLQESGPGLVKPSETLSLTCTVSGGSIRSTNYYWGWIRQPPGKGLEWIGTIYYSGNTYYNPSLKSRVTISVDTSKNQFSLKLSSVTAADTAVYYCARLADVVVVPAARYFDYWGQGILVTVSS

SEQ ID NO: 264 - protein, 125 aa, Artificial Sequence
  C33H49 heavy chain variable region
QLQLQESGPGLVKPSETLSLTCTVSGGSIRSSGFYWGWIRQPPRKGLEWIGTIYYSGNTYYNPSLKSRVTISVDTSKNQFSLKLSSVTAADTAVYFCARLADVVVVPAARYFDNWGQGTLVTVSS

SEQ ID NO: 265 - protein, 125 aa, Artificial Sequence
  C33H51 heavy chain variable region
QLQLQESGPGLVKPSETLSLTCTVSGGSISTGRYYWGWIRQPPGKGVIWIGNIYYSGNTYYNPSLKSRVTISVDTSKNQFSLKLNSVTAADTAVYYCARLGSLVVVPAAMSFDYWGQGTLVTVSS

SEQ ID NO: 266 - protein, 125 aa, Artificial Sequence
  C33H52 heavy chain variable region
QLQLQESGPGLVKPSETLSLTCTVSGGSIRGSSYYWGWVRQPPGKGLEWIGSIYSSGNTYYNPSLKSRVTISVDTSKNQFSLKLSSVTAADTALYYCARLGSLVVVPAAMSFDYWGQGTLVTVSS

SEQ ID NO: 267 - protein, 119 aa, Artificial Sequence
  C33H55 heavy chain variable region
QVQLQESGPGLVKPSGTLSLTCAVSGGSISSSNWWSWVRQPPGRGLEWIGEIYHSGNTNNSPSLKSRVTISADKSKNQFSLKLSSVTAADTAVYFCARIIAVARYFDSWGQGTLVTVSS

SEQ ID NO: 268 - protein, 129 aa, Artificial Sequence
  C33H65 heavy chain variable region
QVQLVESGGGVVQPGRSLRLSCAASGFTFSSYGMHWVRQAPGKGLEWVVVISYDGSNKYYADSVKGRFTISRDNSKNTLYLQMNSLRAEDTAVYYCAKDFRDFDWLPPDSTSYHGMDVWGQGTTVTVSS

SEQ ID NO: 269 - protein, 129 aa, Artificial Sequence
  C33H66 heavy chain variable region
QVQLVESGGGVVQPGRSLRLSCVASGFTFSSYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSS

SEQ ID NO: 270 - protein, 120 aa, Artificial Sequence
  C33H68 heavy chain variable region
EVQLLESGGGLVQPGGSLGLSCAASGFTFSGYAMSWVRQAPGKGLNWVSAIDYSGNDTYYADSVKGRFTISRDNSKNTLYLQMNSLRAEDTAVYYCAKESQLLHGLFEHWGQGILVTVSS

SEQ ID NO: 271 - protein, 120 aa, Artificial Sequence
  C33H69 heavy chain variable region
QLQLQESGPGLVKPSETLSLTCTVSGGSISSSSYYWGWIRQPPGKGLDWIGSINYSGSTYYNPSLKSRVTISVDTSKIQFSLKLRSVTAADTAVYYCARLDGYESPFDYWGQGTLVTVSS

SEQ ID NO: 272 - protein, 125 aa, Artificial Sequence
  C33H70 heavy chain variable region
QLQLQESGPGLVKPSETLSLTCTVSGGSIRGSSYYWGWIRQPPGKGLEWIGSIYSSGNTYYNPSLKSRVTISVDTSKNQFSLKLSSVTAADTAVYYCARLGSLVVVPAAMSFDYWGQGTLVTVSS

SEQ ID NO: 273 - protein, 118 aa, Artificial Sequence
  C33H72 heavy chain variable region
EVQLVESGGGLVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSS

SEQ ID NO: 274 - protein, 119 aa, Artificial Sequence
  C33H73 heavy chain variable region
EVQLLESGGGLVQPGGSLRLSCAASRFTFSSYAMTWVRQAPGKGLEWVSTINISGGSTYYADSVKGRFTISRDNSKNTLYLQMNSLRAEDTAVYYCTKGGYSSGPFDYWGQGTLVSVSS

SEQ ID NO: 275 - protein, 129 aa, Artificial Sequence
  C33H74 heavy chain variable region
QVQLVESGGGVVQPGRSLRLSCAASRFTFSSYGMHWVRQAPGKGLEWVAVISYDGSNKYYADSVKGRFTISRDNSKNTLYLQMNSLRAEDTAVHYCAKDFRSFDWLPPDSASYHGMDVWGQGTTVTVSS

SEQ ID NO: 276 - protein, 121 aa, Artificial Sequence
  C33H76 heavy chain variable region
EVQLLESGGGLVQPGGSLRLSCAASGFTFNYAMSWVRQAPGKGLEWVSAISGSGGSTYYADSVKGRFTISRDISKNTLYLQMNSLRAEDTAVYYCARTYNSGYYDGDFDYWGQGTLVTVSS

SEQ ID NO: 277 - protein, 129 aa, Artificial Sequence
  C33H77 heavy chain variable region
QVQLVESGGGVVQPGRSLRLSCAASGFTFSSYGMHWVRQAPGKGLEWVAVISYDGSNKYYADSVKGRFTISRDNSKNTLFLQMNSLRAEDTAVYYCAKDFRYFDWLPPDSSSYYGMDVWGQGTTVTVSS

SEQ ID NO: 278 - protein, 117 aa, Artificial Sequence
  C33H80 heavy chain variable region
QVQLVQSGSELRKPGASVKVSCKASGYTFTNYAMNWVRQAPGQGLEWMGWINTNTGNPTYAQGFTGRFVFSLDTSVSSAYLQISSLKAEDTAMYYCATDRDRGTDYWGQGTLVTVSS

SEQ ID NO: 279 - protein, 129 aa, Artificial Sequence
  C33H81 heavy chain variable region
QVQLVESGGGVVQPGRSLRLSCAASGFTFSAYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSS

SEQ ID NO: 280 - protein, 129 aa, Artificial Sequence
  C33H84 heavy chain variable region
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDFRSFDWLPPDSTSYYGMDVWGQGTTVTVSS

SEQ ID NO: 281 - protein, 118 aa, Artificial Sequence
  C33H87 heavy chain variable region
EVQLVESGGGFVQPGGSLRLSCAASGFTFSSYWMSWVRQAPGKGLEWVANIKQHGSEKYYVDSVKGRFTISRDNVKNSLYLQMNSLRTEDTAVYYCARDRDLGYFDYWGQGTLVTVSS

SEQ ID NO: 282 - protein, 119 aa, Artificial Sequence
  C33H88 heavy chain variable region
QVQLVQSGSELKKPGASVKVSCKASGYTLTRSAMNWVRQAPGQGLEWMGWINTNTGNPTYAQGFTGRFVFSLDTSVNTAYLLISSLKTEDTAVYYCASDILPGYHEDYWGQGTLVTVSS

SEQ ID NO: 283 - protein, 122 aa, Artificial Sequence
  C33H90 heavy chain variable region
QVQLQQSGPGLVKPSQTLSLTCAISGDSVSSNSAAWNWIRQSPSRGLEWLGRTYYRSKWYNDYALSVQSRITINPDTSKNQFSLQLNSVTPEDTAVYYCAREVAVAASFDYWGQGTLVTVSS

SEQ ID NO: 284 - protein, 125 aa, Artificial Sequence
  C33H91 heavy chain variable region
QLQLQESGPGLVKPSETLSLTCTVSGGSISSRSHYWGWIRQPPGVGLEWIGSIYYTGSTYYNPSLKSRVTISVDTSKNQFSLKLSSVTAADTAVYYCARLADIVVVPAARYFDYWGQGTLVTVSS

SEQ ID NO: 285 - protein, 125 aa, Artificial Sequence
  C33H92 heavy chain variable region
QLQLQESGPGLVKPSETLSLTCTVSGGSIRSSSYYWGWIRQPPGKGPEWIGSIYSSGNTYYNPSLKSRVTISVDTSKNQFSLKLISMTAADTAVFYCARLAATIVVPAARYFDCWGQGTLVTVSS

SEQ ID NO: 286 - protein, 118 aa, Artificial Sequence
  C33H98 heavy chain variable region
EVQLVESGGGFVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSS

SEQ ID NO: 287 - protein, 117 aa, Artificial Sequence
  C33H99 heavy chain variable region
EVQLVESGGGLVQPGGSLRLSCAASGFTFSSYWMTWVRPAPGKGLEWVANIKRDGGEKYYVDSVKGRFTISRDNAANSLYLQMNSLRVEDTAVYYCARPFYDHFDYWGQGTLVTVSS

SEQ ID NO: 288 - protein, 117 aa, Artificial Sequence
  C33H108 heavy chain variable region
QVQLVQSGSELKKPGASVKVSCKASGYTFSTYAMNWVRQAPGQGLEWMGWINTNTGNPTYAQGFTGRFVFSLDTSVSTAYLQISSLKAEDTAVYYCARDRDRGTDYWGQGTLVTVSS

SEQ ID NO: 289 - protein, 119 aa, Artificial Sequence
  C33H249 heavy chain variable region
EVQLVESGGGLVQPGRSLRLSCVASGFTFDDYAIHWVRQAPGKGLEWVSGLSWNGGNIGYADSVKGRFTISRDNAKNSLYLQMNSLKTEDTAFYYCTKDTPYGDYFDYWGQGTLVTVSS

SEQ ID NO: 290 - protein, 119 aa, Artificial Sequence
  C33H250 heavy chain variable region
EVQLVESGGGLVQPGRSLRLSCAGSGFTFDDYAIHWVRQAPGKGLEWVSGLSWNGGNIGYADSVKGRFTISRDNAKNSLYLQLNSLKTEDTAFYYCAKDSPYGDYFDYWGQGTLVTVSS

SEQ ID NO: 291 - protein, 119 aa, Artificial Sequence
  C33H251 heavy chain variable region
EVQLVESGGGLVQPGRSLRLSCAASGFTFDDYAMHWVRQAPGKGLEWVSGIGWSGGSIVYADSVKGRFKISRDNAKNSLYLQMNSLRAEDTALYYCAKDSPYGDFFDYWGQGTLVTVSS

SEQ ID NO: 292 - protein, 119 aa, Artificial Sequence
  C33H252 heavy chain variable region
EVQLVESGGGLVQPGRSLRLSCAASGFTFDDYAMHWVRQAPGKGLEWVSGIGWSGGSIVYADSVKGRFTISRDNAKNSLYLQMNSLRAEDTALYYCAKDSPYGDFFDYWGQGTLVTVSS

SEQ ID NO: 293 - protein, 120 aa, Artificial Sequence
  C33H253 heavy chain variable region
EVQLLESGGGLVQPGGSLKLSCTASGFTFRSYAMSWVRQAPGKGLEWVSAINGYGDGRYYADSVKGRFTISRDNSKNTLYLQMNSLRAEDTAVYSCAKDQGFGELFFDYWGQGTLVTVSS

SEQ ID NO: 294 - protein, 117 aa, Artificial Sequence
  C33H254 heavy chain variable region
QVQLVESGGGVVQPGRSLRLSCAASGFTFSYYGMHWVRQAPDKGLEWVAVIWFDGNNKYYADSVKGRFTISRDNSKNTLYLQMNSLRAEDTAVYYCARDRELLFDYWGQGTLVTVSS

SEQ ID NO: 295 - protein, 129 aa, Artificial Sequence
  C33H255 heavy chain variable region
EVQLVESGGGLVQPGRSLRLSCAASGFTFDDYAMHWVRQVPGEGLEWVSGISWNGGDMVYADSVKGRFTISRDNAKNSLYLQMNSLRPEDTALYYCVKDMPYFDFLTGSDYYYYGMDVWGQGTTVTVSS

SEQ ID NO: 296 - protein, 117 aa, Artificial Sequence
  C33H256 heavy chain variable region
QVQLVESGGGVVQPGRSLRLSCATSGFTFSNYGMHWVRQAPGKGLEWVAVIWYVGSHKYYADSVKGRFTISRDNSKNTLYLQMNSLRAEDTAVYYCARDGSLCFDYWGQGTLVTVSS

SEQ ID NO: 297 - protein, 111 aa, Artificial Sequence
  B23L3 light chain variable region
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIK

SEQ ID NO: 298 - protein, 109 aa, Artificial Sequence
  CD3L66 light chain variable region
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 299 - protein, 110 aa, Artificial Sequence
  CD3L150 light chain variable region
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVL

SEQ ID NO: 300 - protein, 106 aa, Artificial Sequence
  C33L8 light chain variable region
SYELTQPPSVSVSPGQTASIICSGDKLGNKYACWYQQKPGQSPVLVIYQDSKRPSGIPERFSGSNSGNTATLTISGTQAVDEADYYCQAWDSSTYVFGTGTKVTVL

SEQ ID NO: 301 - protein, 107 aa, Artificial Sequence
  C33L10 light chain variable region
SYVLTQPPSVSVAPGQTARITCGGSNIGSKSVHWYQQKPGQAPVMVVYDDSDRPSGIPERFSGSNSGNTATLTISRVEAGDEADYYCQVWDSSSDVVFGGGTKLTVL

SEQ ID NO: 302 - protein, 106 aa, Artificial Sequence
  C33L11 light chain variable region
SYELTQPPSVSVSPGQTASITCSGHKLGDKYACWYQQKPGQSPVVVIYKDSKRPSGIPERFSGSNFGNTATLTISGTQAMDEADYYCQAWDSSTVVFGGGTKLTVL

SEQ ID NO: 303 - protein, 106 aa, Artificial Sequence
  IAPL24 light chain variable region
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 304 - protein, 106 aa, Artificial Sequence
  C33L58 light chain variable region
SYELTQPPSVSVSPGQTASITCSGDKLGDKYACWYQQKPGQSPVLVIYQDYKRPSGIPERFSGSNSGNTATLTISGTQAMDEADYYCQAWDSSTYVFGTGTKVTVL

SEQ ID NO: 305 - protein, 106 aa, Artificial Sequence
  C33L59 light chain variable region
SYELTQPPSVSVSPGQTASITCSGDKLGDKYACWYQQKPGQSPVLVIYQDYKRPSGIPERFSGSNSGNTATLTISGTQTMDEADYYCQAWDISTYVFGTGTKVTVL

SEQ ID NO: 306 - protein, 106 aa, Artificial Sequence
  C33L34 light chain variable region
SYELTQPPSVSVSPGQTASITCSGDKLGDKYACWYQLRPGQSPILVIYQDSNRPSGIPERFSGSNSGNTATLTISGTQAMDEADYYCQAWDSSTWVFGGGTKLTVL

SEQ ID NO: 307 - protein, 106 aa, Artificial Sequence
  N46L109 light chain variable region
SYELTQPPSVSVSPGQTASITCSGDKLGDKYACWYQQKPGQSPVLVIYQDSKRPSGIPERFSGSNSGNTATLTISGTQAMDEADYYCQAWDSSTWVFGGGTKLTVL

SEQ ID NO: 308 - protein, 108 aa, Artificial Sequence
  C33L42 light chain variable region
SYVLTQPPSVSVAPGQTARITCGGNNIGIKSVHWYQQKPGQAPVLVVYDDSDRPPGIPERFSGSNSGNTATLTITRVEAGDEADYYCQVWDSSSDHVVFGGGTKLTVL

SEQ ID NO: 309 - protein, 106 aa, Artificial Sequence
  C33L47 light chain variable region
SYELTQPPSVSVSPGQTASITCSGDKLGDKYACWYQQKPGQSPVVVIYQDRKRPSGIPERFSGSNFGNTATLTISGTQAMDEADYYCQAWDSSTVVFGGGTKLTVL

SEQ ID NO: 310 - protein, 106 aa, Artificial Sequence
  C33L60 light chain variable region
SYELTQPPSVSVSPGQTASITCSGDKLGDKYACWYQQKPGQSPVLVIYQDGKRPSGIPERFSGSNFGNKATLTISGTQAMDEADYYCQAWDRNTVVFGGGTKLTVL

SEQ ID NO: 311 - protein, 113 aa, Artificial Sequence
  C33L17 light chain variable region
DIVMTQSPDSLAVSLGERATINCKSSQSVLYSSNNKNYLAWYQQKAGQPPKLLIYWASTRESGVPDRFSGSGSGTDFILIISSLQAEDVAVYYCQQYYGTPWTFGQGTKVEIK

SEQ ID NO: 312 - protein, 107 aa, Artificial Sequence
  C4LL152 light chain variable region
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK

SEQ ID NO: 313 - protein, 106 aa, Artificial Sequence
  C33L40 light chain variable region
SYELTQPPSVSVSPGQTASITCSGNKLGAKFASWYQQKPGQSPVLVIYQDNKRPSGIPERFSGSNSGNTATLTISGTQAVDEADYYCQAWDSSTVVFGGGTKLTVL

SEQ ID NO: 314 - protein, 107 aa, Artificial Sequence
  C33L32 light chain variable region
SYELTQPPSVSVSPGQTASITCSGDKLGDKYVRWYQQKTGQSPVLVMYQDSKRPSGIRERFYGSNSGNTATPTISGTQAVDEAEYYCQAWDSSTGVVFGGGTKLTVL

SEQ ID NO: 315 - protein, 106 aa, Artificial Sequence
  C33L38 light chain variable region
SYELTQPPSVSVPPGQTASITCSGDKLGDKYACWYQQKPGQSPVLVIYQDNKRPSGIPERFSGSNSGNTATLTISGTQAMDEADYYCQAWGRNTVVFGGGTKLTVL

SEQ ID NO: 316 - protein, 111 aa, Artificial Sequence
  C33L39 light chain variable region
QSALTQPASVSGSPGQSIPISSTGTSSDDGKNNIVSWYQQHPGKAPKLMIYKDSKRPSGVSNRFSGSKSGNTASLTISGLQADDEADYHCCSYAGASNHVVFGGGTKLTVL

SEQ ID NO: 317 - protein, 106 aa, Artificial Sequence
  C33L57 light chain variable region
SYELTQPPSVSVSPGQTASITCSGDELGNKYACWYQQKPGQSPVVVVYQDRKRPSGIPERFSGSNFGNTATLTISGTQAMDEADYYCQAWDSSTVVFGGGTKLTVL

SEQ ID NO: 318 - protein, 111 aa, Artificial Sequence
  C33L73 light chain variable region
QSALTQPASVSGSPGQSITISCTGTSSDVGDYNYVSWYQQHPGKVPKLMIYDVSNRPSGVSNRFSGSMSGNTASLTISGLQAEDEADYYCSSYSSSSALEVFGGGTKLTVL

SEQ ID NO: 319 - protein, 106 aa, Artificial Sequence
  C33L53 light chain variable region
SYELTQPPSVSVSPGQTASITCSGDKLGDKYACWYQQKPGQSPVLVIYQDNKRPSGIPERFSGSNSGNTATLTISGTQAMDEADYYCQAWDSNTVVFGGGTKLTVL

SEQ ID NO: 320 - protein, 106 aa, Artificial Sequence
  C33L66 light chain variable region
SYELTQPPSVSVSPGQTASITCSGDKLGDKYVCWYQQKPGQSPVVVIHQDRKRPSGIPERFSGSNFGNTATLTISGTQAMDEADYYCQAWDSSTVVFGGGTKLTVL

SEQ ID NO: 321 - protein, 106 aa, Artificial Sequence
  C33L35 light chain variable region
SYELTQPPSVSVSPGQTASITCSGDKLGNKYASWYQQKPGQSPVLVIYQDTKRPSGIPERVSGSNSGNTATLTISGTQAMDEADYHCQAWDSSTVVFGGGTKLTVL

SEQ ID NO: 322 - protein, 111 aa, Artificial Sequence
  C33L61 light chain variable region
QSALTQPASVSGSPGQSITISCTGINSDVGSYDLVSWYQQHPGKAPKLLIYDGSERPSGVFGRFSGSKSDNTTSLTISGLQAEDEAAYYCCSYEVTTTYVVFGGGTKLTVL

SEQ ID NO: 323 - protein, 108 aa, Artificial Sequence
  C33L51 light chain variable region
SYVLTQPPSVSVAPGQTARITCGGNNIGSKSVHWSQQKPGQAPVLVVYDDSDRPSGIPERFSGSNSGNTATLTISRVEAGDEADYYCQVWDSNSDHVVFGGGTKLTVL

SEQ ID NO: 324 - protein, 106 aa, Artificial Sequence
  C33L44 light chain variable region
SYELTQPPSVSVSPGQTASITCSGDKLGDKYACWYQQKPGQSPVLVIYQDSNRPSGIPERFSGSNSGNTATLTISETQAMDEADYYCQAWDSSTYVFGTGTKVTVL

SEQ ID NO: 325 - protein, 106 aa, Artificial Sequence
  C33L30 light chain variable region
SYELTQPPSVSVSPGQTVSISCSGDRLGDKYACWYQQKPGQSPVLVIYQDSKRPSGIPERFSGSNSGNTATLTISGTQAMDEADYYCQAWDSSSYVFGTGTKVTVL

SEQ ID NO: 326 - protein, 106 aa, Artificial Sequence
  C33L69 light chain variable region
SYELTQPPSVSVSPGQTASITCSGDKLGSKFACWYQQKPGQSPVLVIYQDSKRPSGIPERFSGSNSGNTATLTISGTQAMDEADYYCQAWDSSTVVFGGGTKLTVL

SEQ ID NO: 327 - protein, 108 aa, Artificial Sequence
  C33L37 light chain variable region
SYVLTQPPSVAVAPGQTARITCGGSNIGKISVHWYQQKAGQAPVLVVHDDRARPSGIPERLSGSNSGTTATLTISRVEVGDEADYYCQVWNSSSVHPVFGGGTKLTVL

SEQ ID NO: 328 - protein, 111 aa, Artificial Sequence
  C33L74 light chain variable region
QSALTQPASVSGSPGQSITISCTGTSSDVGDDNYVSWYQQHPGKAPKLMIYDVSNRPSGVSNRFSGSKSGNTASLTISGLQSEDEADYYCSSYSSSTTLEVFGGGTKLTVL

SEQ ID NO: 329 - protein, 107 aa, Artificial Sequence
  C33L115 light chain variable region
DIQMTQSPSSVWASVGDRVTITCRASQGISSWLAWYQQQPGKAPNLLIYRSSSLQSGVPSRFSGSGSGTDFTLTISSLQPEDFATYYCQQDNSFPYTFGQGTKLEIK

SEQ ID NO: 330 - protein, 107 aa, Artificial Sequence
  C33L116 light chain variable region
DIQMTQSPSSEWASVGDRVTITCRASQGISSWLAWYQQKPGKAPKLLIYGASSWQSGVPSRFSGSGSGTDFTLTISSLQPEDFATYYCQQDNSFPYTFGQGTKLEIK

SEQ ID NO: 331 - protein, 113 aa, Artificial Sequence
  C33L117 light chain variable region
DIVMTQSPDSLAVSLGERATINCKSSQTVLYSSNNKNYLAWYQQKPGQPPKLLISWASTRKSGVPDRFSGSGSGTDFTLTVSSLQAEDVAVYYCQHYYSTPYTFGQGTKLEIK

SEQ ID NO: 332 - protein, 113 aa, Artificial Sequence
  C33L118 light chain variable region
DIVMTQSPDSLAVSLGERATINCKSSQTVFYSSNNKNYLAWYQQKPGQPPKLLISWASTRKSGVPDRFSGSGSGTDFTLTVSSLQAEDVAVYYCQHYYSTPYTFGQGTKLEIK

SEQ ID NO: 333 - protein, 107 aa, Artificial Sequence
  C33L119 light chain variable region
DIQMTQSPSTLSASVGDRVTITCRASQSISSWLAWYQQKPGKAPKLLIYKASSLESGVPSRFSGSGSGTEFTLTISSLQPDDFATYCCQQYNSYPWTFGQGTKVEIK

SEQ ID NO: 334 - protein, 106 aa, Artificial Sequence
  C33L120 light chain variable region
SYELTQPPSVSVSPGQTASITCSGDELGDMYACWYQQKPGQSPLVVIYQDSKRPSGIPERFSGSNSGNTATLTISGTQAMDEAAYYCQTWDTRIAVFGGGTNLTVL

SEQ ID NO: 335 - protein, 106 aa, Artificial Sequence
  C33L121 light chain variable region
SYELTQPPSVSVSPGQTASITCSGDNLGNEHVCWYHQKPGQSPVLVIYQNNKRPSGIPERFSGSNSGNTATLSISGTQATDEADYYCQAWDSTTAVFGGGTKLTVL

SEQ ID NO: 336 - protein, 106 aa, Artificial Sequence
  C33L122 light chain variable region
SYELTQPPSVSVSPGQTANISCSGVTLGYNYAYWYQQKPGQSPILVISQDTQRPSGIPERFSGSNSGNTATLTISGTQAMDEAAYYCQAWDITTVLFGGGTKLTVL

SEQ ID NO: 337 - protein, 106 aa, Artificial Sequence
  C33L132 light chain variable region
SYELTQPPSVSVSPGQTASITCSGDKLGDKYASWYQQKPGQSPVLVIYQDGKRPSGIPERFSGSNFGNKATLTISGTQAMDEADYYCQAWDRNTVVFGGGTKLTVL

SEQ ID NO: 338 - protein, 106 aa, Artificial Sequence
  C33L41 light chain variable region
SYELTQPPSVSVSPGQTASITCSGDKLGNKYASWYQQKPGQSPVLVIYQDSKRPSGIPERFSGSNSGNTATLTISGTQAMDEADYYCQAWDSSTVVFGGGTKLTVL

SEQ ID NO: 339 - protein, 9 aa, Artificial Sequence
  B23H1 HC CDR1
GFSLSTSGM

SEQ ID NO: 340 - protein, 5 aa, Artificial Sequence
  B23H1 HC CDR2
YWDDD

SEQ ID NO: 341 - protein, 9 aa, Artificial Sequence
  B23H1 HC CDR3
LYGFTYGFA

SEQ ID NO: 342 - protein, 7 aa, Artificial Sequence
  CD3H141 HC CDR1
GFTFNTY

SEQ ID NO: 343 - protein, 8 aa, Artificial Sequence
  CD3H141 HC CDR2
RSKYNNYA

SEQ ID NO: 344 - protein, 13 aa, Artificial Sequence
  CD3H141 HC CDR3
HGNFGNSYVSWFA

SEQ ID NO: 345 - protein, 9 aa, Artificial Sequence
  CD3H219 HC CDR1
GDSVFNNNA

SEQ ID NO: 346 - protein, 7 aa, Artificial Sequence
  CD3H219 HC CDR2
YYRSKWL

SEQ ID NO: 347 - protein, 7 aa, Artificial Sequence
  CD3H219 HC CDR3
GYSSSFD

SEQ ID NO: 348 - protein, 9 aa, Artificial Sequence
  C33H42 HC CDR1
GGSISSSSH

SEQ ID NO: 349 - protein, 5 aa, Artificial Sequence
  C33H42 HC CDR2
YYSGN

SEQ ID NO: 350 - protein, 14 aa, Artificial Sequence
  C33H42 HC CDR3
LADVVVVPAARYFD

SEQ ID NO: 351 - protein, 9 aa, Artificial Sequence
  C33H44 HC CDR1
GDSVSSNSA

SEQ ID NO: 352 - protein, 7 aa, Artificial Sequence
  C33H44 HC CDR2
YYRSKWY

SEQ ID NO: 353 - protein, 9 aa, Artificial Sequence
  C33H44 HC CDR3
ETMFRGLMD

SEQ ID NO: 354 - protein, 7 aa, Artificial Sequence
  C33H45 HC CDR1
GFTFSSY

SEQ ID NO: 355 - protein, 6 aa, Artificial Sequence
  C33H45 HC CDR2
SYDGSN

SEQ ID NO: 356 - protein, 19 aa, Artificial Sequence
  C33H45 HC CDR3
DFRSLDWLPPDSTSYDGMD

SEQ ID NO: 357 - protein, 7 aa, Artificial Sequence
  C33H46 HC CDR1
GYTFTNY

SEQ ID NO: 358 - protein, 6 aa, Artificial Sequence
  C33H46 HC CDR2
NTNTGN

SEQ ID NO: 359 - protein, 6 aa, Artificial Sequence
  C33H46 HC CDR3
DREVRD

SEQ ID NO: 360 - protein, 9 aa, Artificial Sequence
  C33H48 HC CDR1
GGSIRSTNY

SEQ ID NO: 361 - protein, 5 aa, Artificial Sequence
  C33H48 HC CDR2
YYSGN

SEQ ID NO: 362 - protein, 14 aa, Artificial Sequence
  C33H48 HC CDR3
LADVVVVPAARYFD

SEQ ID NO: 363 - protein, 9 aa, Artificial Sequence
  C33H49 HC CDR1
GGSIRSSGF

SEQ ID NO: 364 - protein, 5 aa, Artificial Sequence
  C33H49 HC CDR2
YYSGN

SEQ ID NO: 365 - protein, 14 aa, Artificial Sequence
  C33H49 HC CDR3
LADVVVVPAARYFD

SEQ ID NO: 366 - protein, 9 aa, Artificial Sequence
  C33H51 HC CDR1
GGSISTGRY

SEQ ID NO: 367 - protein, 5 aa, Artificial Sequence
  C33H51 HC CDR2
YYSGN

SEQ ID NO: 368 - protein, 14 aa, Artificial Sequence
  C33H51 HC CDR3
LGSLVVVPAAMSFD

SEQ ID NO: 369 - protein, 9 aa, Artificial Sequence
  C33H52 HC CDR1
GGSIRGSSY

SEQ ID NO: 370 - protein, 5 aa, Artificial Sequence
  C33H52 HC CDR2
YSSGN

SEQ ID NO: 371 - protein, 14 aa, Artificial Sequence
  C33H52 HC CDR3
LGSLVVVPAAMSFD

SEQ ID NO: 372 - protein, 8 aa, Artificial Sequence
  C33H55 HC CDR1
GGSISSSN

SEQ ID NO: 373 - protein, 5 aa, Artificial Sequence
  C33H55 HC CDR2
YHSGN

SEQ ID NO: 374 - protein, 9 aa, Artificial Sequence
  C33H55 HC CDR3
IIAVARYFD

SEQ ID NO: 375 - protein, 7 aa, Artificial Sequence
  C33H65 HC CDR1
GFTFSSY

SEQ ID NO: 376 - protein, 6 aa, Artificial Sequence
  C33H65 HC CDR2
SYDGSN

SEQ ID NO: 377 - protein, 19 aa, Artificial Sequence
  C33H65 HC CDR3
DFRDFDWLPPDSTSYHGMD

SEQ ID NO: 378 - protein, 7 aa, Artificial Sequence
  C33H66 HC CDR1
GFTFSSY

SEQ ID NO: 379 - protein, 6 aa, Artificial Sequence
  C33H66 HC CDR2
SYDGSN

SEQ ID NO: 380 - protein, 19 aa, Artificial Sequence
  C33H66 HC CDR3
DFRSFDWLPPDSASYHGMD

SEQ ID NO: 381 - protein, 7 aa, Artificial Sequence
  C33H68 HC CDR1
GFTFSGY

SEQ ID NO: 382 - protein, 6 aa, Artificial Sequence
  C33H68 HC CDR2
DYSGND

SEQ ID NO: 383 - protein, 10 aa, Artificial Sequence
  C33H68 HC CDR3
ESQLLHGLFE

SEQ ID NO: 384 - protein, 9 aa, Artificial Sequence
  C33H69 HC CDR1
GGSISSSSY

SEQ ID NO: 385 - protein, 5 aa, Artificial Sequence
  C33H69 HC CDR2
NYSGS

SEQ ID NO: 386 - protein, 9 aa, Artificial Sequence
  C33H69 HC CDR3
LDGYESPFD

SEQ ID NO: 387 - protein, 9 aa, Artificial Sequence
  C33H70 HC CDR1
GGSIRGSSY

SEQ ID NO: 388 - protein, 5 aa, Artificial Sequence
  C33H70 HC CDR2
YSSGN

SEQ ID NO: 389 - protein, 14 aa, Artificial Sequence
  C33H70 HC CDR3
LGSLVVVPAAMSFD

SEQ ID NO: 390 - protein, 7 aa, Artificial Sequence
  C33H72 HC CDR1
GFTFSSY

SEQ ID NO: 391 - protein, 6 aa, Artificial Sequence
  C33H72 HC CDR2
KQHGSE

SEQ ID NO: 392 - protein, 8 aa, Artificial Sequence
  C33H72 HC CDR3
DRDLGYFD

SEQ ID NO: 393 - protein, 7 aa, Artificial Sequence
  C33H73 HC CDR1
RFTFSSY

SEQ ID NO: 394 - protein, 6 aa, Artificial Sequence
  C33H73 HC CDR2
NISGGS

SEQ ID NO: 395 - protein, 9 aa, Artificial Sequence
  C33H73 HC CDR3
GGYSSGPFD

SEQ ID NO: 396 - protein, 7 aa, Artificial Sequence
  C33H74 HC CDR1
RFTFSSY

SEQ ID NO: 397 - protein, 6 aa, Artificial Sequence
  C33H74 HC CDR2
SYDGSN

SEQ ID NO: 398 - protein, 19 aa, Artificial Sequence
  C33H74 HC CDR3
DFRSFDWLPPDSASYHGMD

SEQ ID NO: 399 - protein, 6 aa, Artificial Sequence
  C33H76 HC CDR1
GFTFNY

SEQ ID NO: 400 - protein, 6 aa, Artificial Sequence
  C33H76 HC CDR2
SGSGGS

SEQ ID NO: 401 - protein, 12 aa, Artificial Sequence
  C33H76 HC CDR3
TYNSGYYDGDFD

SEQ ID NO: 402 - protein, 7 aa, Artificial Sequence
  C33H78 HC CDR1
GFTFSSY

SEQ ID NO: 403 - protein, 6 aa, Artificial Sequence
  C33H78 HC CDR2
SYDGSN

SEQ ID NO: 404 - protein, 19 aa, Artificial Sequence
  C33H78 HC CDR3
DFRYFDWLPPDSSSYYGMD

SEQ ID NO: 405 - protein, 7 aa, Artificial Sequence
  C33H80 HC CDR1
GYTFTNY

SEQ ID NO: 406 - protein, 6 aa, Artificial Sequence
  C33H80 HC CDR2
NTNTGN

SEQ ID NO: 407 - protein, 7 aa, Artificial Sequence
  C33H80 HC CDR3
DRDRGTD

SEQ ID NO: 408 - protein, 7 aa, Artificial Sequence
  C33H81 HC CDR1
GFTFSAY

SEQ ID NO: 409 - protein, 6 aa, Artificial Sequence
  C33H81 HC CDR2
SYDGSN

SEQ ID NO: 410 - protein, 19 aa, Artificial Sequence
  C33H81 HC CDR3
DFRSFDWLPPDSASYHGMD

SEQ ID NO: 411 - protein, 7 aa, Artificial Sequence
  C33H84 HC CDR1
GFTFSSY

SEQ ID NO: 412 - protein, 6 aa, Artificial Sequence
  C33H84 HC CDR2
SYDGSN

SEQ ID NO: 413 - protein, 19 aa, Artificial Sequence
  C33H84 HC CDR3
DFRSFDWLPPDSTSYYGMD

SEQ ID NO: 414 - protein, 7 aa, Artificial Sequence
  C33H87 HC CDR1
GFTFSSY

SEQ ID NO: 415 - protein, 6 aa, Artificial Sequence
  C33H87 HC CDR2
KQHGSE

SEQ ID NO: 416 - protein, 8 aa, Artificial Sequence
  C33H87 HC CDR3
DRDLGYFD

SEQ ID NO: 417 - protein, 7 aa, Artificial Sequence
  C33H88 HC CDR1
GYTLTRS

SEQ ID NO: 418 - protein, 6 aa, Artificial Sequence
  C33H88 HC CDR2
NTNTGN

SEQ ID NO: 419 - protein, 9 aa, Artificial Sequence
  C33H88 HC CDR3
DILPGYHED

SEQ ID NO: 420 - protein, 9 aa, Artificial Sequence
  C33H90 HC CDR1
GDSVSSNSA

SEQ ID NO: 421 - protein, 7 aa, Artificial Sequence
  C33H90 HC CDR2
YYRSKWY

SEQ ID NO: 422 - protein, 9 aa, Artificial Sequence
  C33H90 HC CDR3
EVAVAASFD

SEQ ID NO: 423 - protein, 9 aa, Artificial Sequence
  C33H91 HC CDR1
GGSISSRSH

SEQ ID NO: 424 - protein, 5 aa, Artificial Sequence
  C33H91 HC CDR2
YYTGS

SEQ ID NO: 425 - protein, 14 aa, Artificial Sequence
  C33H91 HC CDR3
LADIVVVPAARYFD

SEQ ID NO: 426 - protein, 9 aa, Artificial Sequence
  C33H92 HC CDR1
GGSIRSSSY

SEQ ID NO: 427 - protein, 5 aa, Artificial Sequence
  C33H92 HC CDR2
YSSGN

SEQ ID NO: 428 - protein, 14 aa, Artificial Sequence
  C33H92 HC CDR3
LAATIVVPAARYFD

SEQ ID NO: 429 - protein, 7 aa, Artificial Sequence
  C33H98 HC CDR1
GFTFSSY

SEQ ID NO: 430 - protein, 6 aa, Artificial Sequence
  C33H98 HC CDR2
KQHGSE

SEQ ID NO: 431 - protein, 8 aa, Artificial Sequence
  C33H98 HC CDR3
DRDLGYFD

SEQ ID NO: 432 - protein, 7 aa, Artificial Sequence
  C33H99 HC CDR1
GFTFSSY

SEQ ID NO: 433 - protein, 6 aa, Artificial Sequence
  C33H99 HC CDR2
KRDGGE

SEQ ID NO: 434 - protein, 7 aa, Artificial Sequence
  C33H99 HC CDR3
PFYDHFD

SEQ ID NO: 435 - protein, 7 aa, Artificial Sequence
  C33H108 HC CDR1
GYTFSTY

SEQ ID NO: 436 - protein, 6 aa, Artificial Sequence
  C33H108 HC CDR2
NTNTGN

SEQ ID NO: 437 - protein, 7 aa, Artificial Sequence
  C33H108 HC CDR3
DRDRGTD

SEQ ID NO: 438 - protein, 7 aa, Artificial Sequence
  C33H249 HC CDR1
GFTFDDY

SEQ ID NO: 439 - protein, 6 aa, Artificial Sequence
  C33H249 HC CDR2
SWNGGN

SEQ ID NO: 440 - protein, 9 aa, Artificial Sequence
  C33H249 HC CDR3
DTPYGDYFD

SEQ ID NO: 441 - protein, 7 aa, Artificial Sequence
  C33H250 HC CDR1
GFTFDDY

SEQ ID NO: 442 - protein, 6 aa, Artificial Sequence
  C33H250 HC CDR2
SWNGGN

SEQ ID NO: 443 - protein, 9 aa, Artificial Sequence
  C33H250 HC CDR3
DSPYGDYFD

SEQ ID NO: 444 - protein, 7 aa, Artificial Sequence
  C33H251 HC CDR1
GFTFDDY

SEQ ID NO: 445 - protein, 6 aa, Artificial Sequence
  C33H251 HC CDR2
GWSGGS

SEQ ID NO: 446 - protein, 9 aa, Artificial Sequence
  C33H251 HC CDR3
DSPYGDFFD

SEQ ID NO: 447 - protein, 7 aa, Artificial Sequence
  C33H252 HC CDR1
GFTFDDY

SEQ ID NO: 448 - protein, 6 aa, Artificial Sequence
  C33H252 HC CDR2
GWSGGS

SEQ ID NO: 449 - protein, 9 aa, Artificial Sequence
  C33H252 HC CDR3
DSPYGDFFD

SEQ ID NO: 450 - protein, 7 aa, Artificial Sequence
  C33H253 HC CDR1
GFTFRSY

SEQ ID NO: 451 - protein, 6 aa, Artificial Sequence
  C33H253 HC CDR2
NGYGDG

SEQ ID NO: 452 - protein, 10 aa, Artificial Sequence
  C33H253 HC CDR3
DQGFGELFFD

SEQ ID NO: 453 - protein, 7 aa, Artificial Sequence
  C33H254 HC CDR1
GFTFSYY

SEQ ID NO: 454 - protein, 6 aa, Artificial Sequence
  C33H254 HC CDR2
WFDGNN

SEQ ID NO: 455 - protein, 7 aa, Artificial Sequence
  C33H254 HC CDR3
DRELLFD

SEQ ID NO: 456 - protein, 7 aa, Artificial Sequence
  C33H255 HC CDR1
GFTFDDY

SEQ ID NO: 457 - protein, 6 aa, Artificial Sequence
  C33H255 HC CDR2
SWNGGD

SEQ ID NO: 458 - protein, 19 aa, Artificial Sequence
  C33H255 HC CDR3
DMPYFDFLTGSDYYYYGMD

SEQ ID NO: 459 - protein, 7 aa, Artificial Sequence
  C33H256 HC CDR1
GFTFSNY

SEQ ID NO: 460 - protein, 6 aa, Artificial Sequence
  C33H256 HC CDR2
WYVGSH

SEQ ID NO: 461 - protein, 7 aa, Artificial Sequence
  C33H256 HC CDR3
DGSLCFD

SEQ ID NO: 462 - protein, 11 aa, Artificial Sequence
  B23L3 LC CDR1
SQSVDYNGISY

SEQ ID NO: 463 - protein, 3 aa, Artificial Sequence
  B23L3 LC CDR2
AAS

SEQ ID NO: 464 - protein, 6 aa, Artificial Sequence
  B23L3 LC CDR3
IIEDPW

SEQ ID NO: 465 - protein, 10 aa, Artificial Sequence
  CD3L66 LC CDR1
STGAVTTSNY

SEQ ID NO: 466 - protein, 3 aa, Artificial Sequence
  CD3L66 LC CDR2
GTN

SEQ ID NO: 467 - protein, 6 aa, Artificial Sequence
  CD3L66 LC CDR3
WYSNLW

SEQ ID NO: 468 - protein, 10 aa, Artificial Sequence
  CD3L150 LC CDR1
TSSNIGTYKF

SEQ ID NO: 469 - protein, 3 aa, Artificial Sequence
  CD3L150 LC CDR2
EVS

SEQ ID NO: 470 - protein, 7 aa, Artificial Sequence
  CD3L150 LC CDR3
YAGSGTL

SEQ ID NO: 471 - protein, 7 aa, Artificial Sequence
  C33L8 LC CDR1
DKLGNKY

SEQ ID NO: 472 - protein, 3 aa, Artificial Sequence
  C33L8 LC CDR2
QDS

SEQ ID NO: 473 - protein, 6 aa, Artificial Sequence
  C33L8 LC CDR3
WDSSTY

SEQ ID NO: 474 - protein, 7 aa, Artificial Sequence
  C33L10 LC CDR1
SNIGSKS

SEQ ID NO: 475 - protein, 3 aa, Artificial Sequence
  C33L10 LC CDR2
DDS

SEQ ID NO: 476 - protein, 7 aa, Artificial Sequence
  C33L10 LC CDR3
WDSSSDV

SEQ ID NO: 477 - protein, 7 aa, Artificial Sequence
  C33L11 LC CDR1
HKLGDKY

SEQ ID NO: 478 - protein, 3 aa, Artificial Sequence
  C33L11 LC CDR2
KDS

SEQ ID NO: 479 - protein, 6 aa, Artificial Sequence
  C33L11 LC CDR3
WDSSTV

SEQ ID NO: 480 - protein, 7 aa, Artificial Sequence
  IAPL24 LC CDR1
DKLGDKY

SEQ ID NO: 481 - protein, 3 aa, Artificial Sequence
  IAPL24 LC CDR2
QDS

SEQ ID NO: 482 - protein, 6 aa, Artificial Sequence
  IAPL24 LC CDR3
WDSSTV

SEQ ID NO: 483 - protein, 7 aa, Artificial Sequence
  C33L58 LC CDR1
DKLGDKY

SEQ ID NO: 484 - protein, 3 aa, Artificial Sequence
  C33L58 LC CDR2
QDY

SEQ ID NO: 485 - protein, 6 aa, Artificial Sequence
  C33L58 LC CDR3
WDSSTY

SEQ ID NO: 486 - protein, 7 aa, Artificial Sequence
  C33L59 LC CDR1
DKLGDKY

SEQ ID NO: 487 - protein, 3 aa, Artificial Sequence
  C33L59 LC CDR2
QDY

SEQ ID NO: 488 - protein, 6 aa, Artificial Sequence
  C33L59 LC CDR3
WDISTY

SEQ ID NO: 489 - protein, 7 aa, Artificial Sequence
  C33L34 LC CDR1
DKLGDKY

SEQ ID NO: 490 - protein, 3 aa, Artificial Sequence
  C33L34 LC CDR2
QDS

SEQ ID NO: 491 - protein, 6 aa, Artificial Sequence
  C33L34 LC CDR3
WDSSTW

SEQ ID NO: 492 - protein, 7 aa, Artificial Sequence
  N46L109 LC CDR1
DKLGDKY

SEQ ID NO: 493 - protein, 3 aa, Artificial Sequence
  N46L109 LC CDR2
QDS

SEQ ID NO: 494 - protein, 6 aa, Artificial Sequence
  N46L109 LC CDR3
WDSSTW

SEQ ID NO: 495 - protein, 7 aa, Artificial Sequence
  C33L42 LC CDR1
NNIGIKS

SEQ ID NO: 496 - protein, 3 aa, Artificial Sequence
  C33L42 LC CDR2
DDS

SEQ ID NO: 497 - protein, 8 aa, Artificial Sequence
  C33L42 LC CDR3
WDSSSDHV

SEQ ID NO: 498 - protein, 7 aa, Artificial Sequence
  C33L47 LC CDR1
DKLGDKY

SEQ ID NO: 499 - protein, 3 aa, Artificial Sequence
  C33L47 LC CDR2
QDR

SEQ ID NO: 500 - protein, 6 aa, Artificial Sequence
  C33L47 LC CDR3
WDSSTV

SEQ ID NO: 501 - protein, 7 aa, Artificial Sequence
  C33L60 LC CDR1
DKLGDKY

SEQ ID NO: 502 - protein, 3 aa, Artificial Sequence
  C33L60 LC CDR2
QDG

SEQ ID NO: 503 - protein, 6 aa, Artificial Sequence
  C33L60 LC CDR3
WDRNTV

SEQ ID NO: 504 - protein, 13 aa, Artificial Sequence
  C33L17 LC CDR1
SQSVLYSSNNKNY

SEQ ID NO: 505 - protein, 3 aa, Artificial Sequence
  C33L17 LC CDR2
WAS

SEQ ID NO: 506 - protein, 6 aa, Artificial Sequence
  C33L17 LC CDR3
YYGTPW

SEQ ID NO: 507 - protein, 7 aa, Artificial Sequence
  C4LL152 LC CDR1
SQGISSW

SEQ ID NO: 508 - protein, 3 aa, Artificial Sequence
  C4LL152 LC CDR2
AAS

SEQ ID NO: 509 - protein, 6 aa, Artificial Sequence
  C4LL152 LC CDR3
ANSFPF

SEQ ID NO: 510 - protein, 7 aa, Artificial Sequence
  C33L40 LC CDR1
NKLGAKF

SEQ ID NO: 511 - protein, 3 aa, Artificial Sequence
  C33L40 LC CDR2
QDN

SEQ ID NO: 512 - protein, 6 aa, Artificial Sequence
  C33L40 LC CDR3
WDSSTV

SEQ ID NO: 513 - protein, 7 aa, Artificial Sequence
  C33L32 LC CDR1
DKLGDKY

SEQ ID NO: 514 - protein, 3 aa, Artificial Sequence
  C33L32 LC CDR2
QDS

SEQ ID NO: 515 - protein, 7 aa, Artificial Sequence
  C33L32 LC CDR3
WDSSTGV

SEQ ID NO: 516 - protein, 7 aa, Artificial Sequence
  C33L38 LC CDR1
DKLGDKY

SEQ ID NO: 517 - protein, 3 aa, Artificial Sequence
  C33L38 LC CDR2
QDN

SEQ ID NO: 518 - protein, 6 aa, Artificial Sequence
  C33L38 LC CDR3
WGRNTV

SEQ ID NO: 519 - protein, 10 aa, Artificial Sequence
  C33L39 LC CDR1
TSSDDGKNNI

SEQ ID NO: 520 - protein, 3 aa, Artificial Sequence
  C33L39 LC CDR2
KDS

SEQ ID NO: 521 - protein, 8 aa, Artificial Sequence
  C33L39 LC CDR3
YAGASNHV

SEQ ID NO: 522 - protein, 7 aa, Artificial Sequence
  C33L57 LC CDR1
DELGNKY

SEQ ID NO: 523 - protein, 3 aa, Artificial Sequence
  C33L57 LC CDR2
QDR

SEQ ID NO: 524 - protein, 6 aa, Artificial Sequence
  C33L57 LC CDR3
WDSSTV

SEQ ID NO: 525 - protein, 10 aa, Artificial Sequence
  C33L73 LC CDR1
TSSDVGDYNY

SEQ ID NO: 526 - protein, 3 aa, Artificial Sequence
  C33L73 LC CDR2
DVS

SEQ ID NO: 527 - protein, 8 aa, Artificial Sequence
  C33L73 LC CDR3
YSSSSALE

SEQ ID NO: 528 - protein, 7 aa, Artificial Sequence
  C33L53 LC CDR1
DKLGDKY

SEQ ID NO: 529 - protein, 3 aa, Artificial Sequence
  C33L53 LC CDR2
QDN

SEQ ID NO: 530 - protein, 6 aa, Artificial Sequence
  C33L53 LC CDR3
WDSNTV

SEQ ID NO: 531 - protein, 7 aa, Artificial Sequence
  C33L66 LC CDR1
DKLGDKY

SEQ ID NO: 532 - protein, 3 aa, Artificial Sequence
  C33L66 LC CDR2
QDR

SEQ ID NO: 533 - protein, 6 aa, Artificial Sequence
  C33L66 LC CDR3
WDSSTV

SEQ ID NO: 534 - protein, 7 aa, Artificial Sequence
  C33L35 LC CDR1
DKLGNKY

SEQ ID NO: 535 - protein, 3 aa, Artificial Sequence
  C33L35 LC CDR2
QDT

SEQ ID NO: 536 - protein, 6 aa, Artificial Sequence
  C33L35 LC CDR3
WDSSTV

SEQ ID NO: 537 - protein, 10 aa, Artificial Sequence
  C33L61 LC CDR1
INSDVGSYDL

SEQ ID NO: 538 - protein, 3 aa, Artificial Sequence
  C33L61 LC CDR2
DGS

SEQ ID NO: 539 - protein, 8 aa, Artificial Sequence
  C33L61 LC CDR3
YEVTTTYV

SEQ ID NO: 540 - protein, 7 aa, Artificial Sequence
  C33L51 LC CDR1
NNIGSKS

SEQ ID NO: 541 - protein, 3 aa, Artificial Sequence
  C33L51 LC CDR2
DDS

SEQ ID NO: 542 - protein, 8 aa, Artificial Sequence
  C33L51 LC CDR3
WDSNSDHV

SEQ ID NO: 543 - protein, 7 aa, Artificial Sequence
  C33L44 LC CDR1
DKLGDKY

SEQ ID NO: 544 - protein, 3 aa, Artificial Sequence
  C33L44 LC CDR2
QDS

SEQ ID NO: 545 - protein, 6 aa, Artificial Sequence
  C33L44 LC CDR3
WDSSTY

SEQ ID NO: 546 - protein, 7 aa, Artificial Sequence
  C33L30 LC CDR1
DRLGDKY

SEQ ID NO: 547 - protein, 3 aa, Artificial Sequence
  C33L30 LC CDR2
QDS

SEQ ID NO: 548 - protein, 6 aa, Artificial Sequence
  C33L30 LC CDR3
WDSSSY

SEQ ID NO: 549 - protein, 7 aa, Artificial Sequence
  C33L69 LC CDR1
DKLGSKF

SEQ ID NO: 550 - protein, 3 aa, Artificial Sequence
  C33L69 LC CDR2
QDS

SEQ ID NO: 551 - protein, 6 aa, Artificial Sequence
  C33L69 LC CDR3
WDSSTV

SEQ ID NO: 552 - protein, 7 aa, Artificial Sequence
  C33L37 LC CDR1
SNIGKIS

SEQ ID NO: 553 - protein, 3 aa, Artificial Sequence
  C33L37 LC CDR2
DDR

SEQ ID NO: 554 - protein, 8 aa, Artificial Sequence
  C33L37 LC CDR3
WNSSSVHP

SEQ ID NO: 555 - protein, 10 aa, Artificial Sequence
  C33L74 LC CDR1
TSSDVGDDNY

SEQ ID NO: 556 - protein, 3 aa, Artificial Sequence
  C33L74 LC CDR2
DVS

SEQ ID NO: 557 - protein, 8 aa, Artificial Sequence
  C33L74 LC CDR3
YSSSTTLE

SEQ ID NO: 558 - protein, 7 aa, Artificial Sequence
  C33L115 LC CDR1
SQGISSW

SEQ ID NO: 559 - protein, 3 aa, Artificial Sequence
  C33L115 LC CDR2
RSS

SEQ ID NO: 560 - protein, 6 aa, Artificial Sequence
  C33L115 LC CDR3
DNSFPY

SEQ ID NO: 561 - protein, 7 aa, Artificial Sequence
  C33L116 LC CDR1
SQGISSW

SEQ ID NO: 562 - protein, 3 aa, Artificial Sequence
  C33L116 LC CDR2
GAS

SEQ ID NO: 563 - protein, 6 aa, Artificial Sequence
  C33L116 LC CDR3
DNSFPY

SEQ ID NO: 564 - protein, 13 aa, Artificial Sequence
  C33L117 LC CDR1
SQTVLYSSNNKNY

SEQ ID NO: 565 - protein, 3 aa, Artificial Sequence
  C33L117 LC CDR2
WAS

SEQ ID NO: 566 - protein, 6 aa, Artificial Sequence
  C33L117 LC CDR3
YYSTPY

SEQ ID NO: 567 - protein, 13 aa, Artificial Sequence
  C33L118 LC CDR1
SQTVFYSSNNKNY

SEQ ID NO: 568 - protein, 3 aa, Artificial Sequence
  C33L118 LC CDR2
WAS

SEQ ID NO: 569 - protein, 6 aa, Artificial Sequence
  C33L118 LC CDR3
YYSTPY

SEQ ID NO: 570 - protein, 7 aa, Artificial Sequence
  C33L119 LC CDR1
SQSISSW

SEQ ID NO: 571 - protein, 3 aa, Artificial Sequence
  C33L119 LC CDR2
KAS

SEQ ID NO: 572 - protein, 6 aa, Artificial Sequence
  C33L119 LC CDR3
YNSYPW

SEQ ID NO: 573 - protein, 7 aa, Artificial Sequence
  C33L120 LC CDR1
DELGDMY

SEQ ID NO: 574 - protein, 3 aa, Artificial Sequence
  C33L120 LC CDR2
QDS

SEQ ID NO: 575 - protein, 6 aa, Artificial Sequence
  C33L120 LC CDR3
WDTRIA

SEQ ID NO: 576 - protein, 7 aa, Artificial Sequence
  C33L121 LC CDR1
DNLGNEH

SEQ ID NO: 577 - protein, 3 aa, Artificial Sequence
  C33L121 LC CDR2
QNN

SEQ ID NO: 578 - protein, 6 aa, Artificial Sequence
  C33L121 LC CDR3
WDSTTA

SEQ ID NO: 579 - protein, 7 aa, Artificial Sequence
  C33L122 LC CDR1
VTLGYNY

SEQ ID NO: 580 - protein, 3 aa, Artificial Sequence
  C33L122 LC CDR2
QDT

SEQ ID NO: 581 - protein, 6 aa, Artificial Sequence
  C33L122 LC CDR3
WDITTV

SEQ ID NO: 582 - protein, 7 aa, Artificial Sequence
  C33L132 LC CDR1
DKLGDKY

SEQ ID NO: 583 - protein, 3 aa, Artificial Sequence
  C33L132 LC CDR2
QDG

SEQ ID NO: 584 - protein, 6 aa, Artificial Sequence
  C33L132 LC CDR3
WDRNTV

SEQ ID NO: 585 - protein, 7 aa, Artificial Sequence
  C33L41 LC CDR1
DKLGNKY

SEQ ID NO: 586 - protein, 3 aa, Artificial Sequence
  C33L41 LC CDR2
QDS

SEQ ID NO: 587 - protein, 6 aa, Artificial Sequence
  C33L41 LC CDR3
WDSSTV

SEQ ID NO: 588 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 589 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 590 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 591 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

The invention claimed is:

1. An isolated monoclonal antibody or antigen-binding fragment thereof that specifically binds the C2 domain of human and cynomolgus monkey CD33, wherein the antibody or antigen-binding fragment thereof comprises a heavy chain complementarity determining region 1 (HCDR1), HCDR2, and HCDR3, and a light chain complementarity determining region 1 (LCDR1), LCDR2, and LCDR3, comprising the amino acid sequence of:
   a. SEQ ID NOs:447, 448, 449, 567, 568, and 569, respectively;
   b. SEQ ID NOs:444, 445, 446, 564, 565, and 566, respectively;
   c. SEQ ID NOs:354, 355, 356, 477, 478, and 479, respectively;
   d. SEQ ID NOs:378, 379, 380, 501, 502, and 503, respectively;
   e. SEQ ID NOs:411, 412, 413, 531, 532, and 533, respectively;
   f. SEQ ID NOs:348, 349, 350, 471, 472, and 473, respectively;
   g. SEQ ID NOs:360, 361, 362, 483, 484, and 485, respectively;
   h. SEQ ID NOs:363, 364, 365, 486, 487, and 488, respectively;
   i. SEQ ID NOs:366, 367, 368, 489, 490, and 491, respectively;
   j. SEQ ID NOs:369, 370, 371, 492, 493, and 494, respectively;
   k. SEQ ID NOs:387, 388, 389, 492, 493, and 494, respectively;
   l. SEQ ID NOs:402, 403, 404, 522, 523, and 524, respectively;
   m. SEQ ID NOs:408, 409, 410, 528, 529, and 530, respectively;
   n. SEQ ID NOs:423, 424, 425, 543, 544, and 545, respectively; or
   o. SEQ ID NOs:426, 427, 428, 546, 547, and 548, respectively.

2. The isolated monoclonal antibody or antigen-binding fragment thereof of claim 1, comprising
   a. a heavy chain variable region comprising an amino acid sequence that is at least 95% identical to the amino acid sequence of SEQ ID NO:292, and a light chain variable region comprising an amino acid sequence that is at least 95% identical to the amino acid sequence of SEQ ID NO:332;
   b. a heavy chain variable region comprising an amino acid sequence that is at least 95% identical to the amino acid sequence of SEQ ID NO:291, and a light chain variable region comprising an amino acid sequence that is at least 95% identical to the amino acid sequence of SEQ ID NO:331;
   c. a heavy chain variable region comprising an amino acid sequence that is at least 95% identical to the amino acid sequence of SEQ ID NO:261, and a light chain variable region comprising an amino acid sequence that is at least 95% identical to the amino acid sequence of SEQ ID NO:302;
   d. a heavy chain variable region comprising an amino acid sequence that is at least 95% identical to the amino acid sequence of SEQ ID NO:269, and a light chain variable region comprising an amino acid sequence that is at least 95% identical to the amino acid sequence of SEQ ID NO:310;
   e. a heavy chain variable region comprising an amino acid sequence that is at least 95% identical to the amino acid sequence of SEQ ID NO:280, and a light chain variable region comprising an amino acid sequence that is at least 95% identical to the amino acid sequence of SEQ ID NO:322;
   f. a heavy chain variable region comprising an amino acid sequence that is at least 95% identical to the amino acid sequence of SEQ ID NO:259, and a light chain variable region comprising an amino acid sequence that is at least 95% identical to the amino acid sequence of SEQ ID NO:300;

g. a heavy chain variable region comprising an amino acid sequence that is at least 95% identical to the amino acid sequence of SEQ ID NO:263, and a light chain variable region comprising an amino acid sequence that is at least 95% identical to the amino acid sequence of SEQ ID NO:304;

h. a heavy chain variable region comprising an amino acid sequence that is at least 95% identical to the amino acid sequence of SEQ ID NO:264, and a light chain variable region comprising an amino acid sequence that is at least 95% identical to the amino acid sequence of SEQ ID NO:305;

i. a heavy chain variable region comprising an amino acid sequence that is at least 95% identical to the amino acid sequence of SEQ ID NO:265, and a light chain variable region comprising an amino acid sequence that is at least 95% identical to the amino acid sequence of SEQ ID NO:306;

j. a heavy chain variable region comprising an amino acid sequence that is at least 95% identical to the amino acid sequence of SEQ ID NO:266, and a light chain variable region comprising an amino acid sequence that is at least 95% identical to the amino acid sequence of SEQ ID NO:307;

k. a heavy chain variable region comprising an amino acid sequence that is at least 95% identical to the amino acid sequence of SEQ ID NO:272, and a light chain variable region comprising an amino acid sequence that is at least 95% identical to the amino acid sequence of SEQ ID NO:307;

l. a heavy chain variable region comprising an amino acid sequence that is at least 95% identical to the amino acid sequence of SEQ ID NO:277, and a light chain variable region comprising an amino acid sequence that is at least 95% identical to the amino acid sequence of SEQ ID NO:317;

m. a heavy chain variable region comprising an amino acid sequence that is at least 95% identical to the amino acid sequence of SEQ ID NO:279, and a light chain variable region comprising an amino acid sequence that is at least 95% identical to the amino acid sequence of SEQ ID NO:319;

n. a heavy chain variable region comprising an amino acid sequence that is at least 95% identical to the amino acid sequence of SEQ ID NO:284, and a light chain variable region comprising an amino acid sequence that is at least 95% identical to the amino acid sequence of SEQ ID NO:324; or o. a heavy chain variable region comprising an amino acid sequence that is at least 95% identical to the amino acid sequence of SEQ ID NO:285, and a light chain variable region comprising an amino acid sequence that is at least 95% identical to the amino acid sequence of SEQ ID NO:325.

3. The isolated monoclonal antibody or antigen-binding fragment thereof of claim 1, comprising:

a. a heavy chain variable region comprising the amino acid sequence of SEQ ID NO:292, and a light chain variable region comprising the amino acid sequence of SEQ ID NO:332;

b. a heavy chain variable region comprising the amino acid sequence of SEQ ID NO:291, and a light chain variable region comprising the amino acid sequence of SEQ ID NO:331;

c. a heavy chain variable region comprising the amino acid sequence of SEQ ID NO:261, and a light chain variable region comprising the amino acid sequence of SEQ ID NO:302;

d. a heavy chain variable region comprising the amino acid sequence of SEQ ID NO:269, and a light chain variable region comprising the amino acid sequence of SEQ ID NO:310;

e. a heavy chain variable region comprising the amino acid sequence of SEQ ID NO:280, and a light chain variable region comprising the amino acid sequence of SEQ ID NO:322;

f. a heavy chain variable region comprising the amino acid sequence of SEQ ID NO:259, and a light chain variable region comprising the amino acid sequence of SEQ ID NO:300;

g. a heavy chain variable region comprising the amino acid sequence of SEQ ID NO:263, and a light chain variable region comprising the amino acid sequence of SEQ ID NO:304;

h. a heavy chain variable region comprising the amino acid sequence of SEQ ID NO:264, and a light chain variable region comprising the amino acid sequence of SEQ ID NO:305;

i. a heavy chain variable region comprising the amino acid sequence of SEQ ID NO:265, and a light chain variable region comprising the amino acid sequence of SEQ ID NO:306;

j. a heavy chain variable region comprising the amino acid sequence of SEQ ID NO:266, and a light chain variable region comprising the amino acid sequence of SEQ ID NO:307;

k. a heavy chain variable region comprising the amino acid sequence of SEQ ID NO:272, and a light chain variable region comprising the amino acid sequence of SEQ ID NO:307;

l. a heavy chain variable region comprising the amino acid sequence of SEQ ID NO:277, and a light chain variable region comprising the amino acid sequence of SEQ ID NO:317;

m. a heavy chain variable region comprising the amino acid sequence of SEQ ID NO:279, and a light chain variable region comprising the amino acid sequence of SEQ ID NO:319;

n. a heavy chain variable region comprising the amino acid sequence of SEQ ID NO:284, and a light chain variable region comprising the amino acid sequence of SEQ ID NO:324; or o. a heavy chain variable region comprising the amino acid sequence of SEQ ID NO:285, and a light chain variable region comprising the amino acid sequence of SEQ ID NO:325.

4. The isolated monoclonal antibody or antigen-binding fragment thereof of claim 1, wherein the antibody or antigen-binding fragment thereof comprises an IgG1 comprising a low fucose backbone.

5. The isolated monoclonal antibody or antigen-binding fragment thereof of claim 1, wherein the antibody or antigen-binding fragment thereof is chimeric.

6. The isolated monoclonal antibody or antigen-binding fragment thereof of claim 1, wherein the antibody or antigen-binding fragment thereof is human or humanized.

7. The isolated monoclonal antibody or antigen-binding fragment thereof of claim 1, wherein the antibody or antigen-binding fragment thereof is conjugated to a therapeutic agent.

8. The isolated monoclonal antibody or antigen-binding fragment thereof of claim 1, wherein the antibody or antigen-binding fragment thereof is a bispecific antibody or antigen-binding fragment.

9. The isolated bispecific antibody or antigen-binding fragment thereof of claim 8, wherein the bispecific antibody or antigen-binding fragment has binding specificity for a first epitope and a second epitope.

10. The isolated monoclonal antibody or antigen-binding fragment thereof of claim 1, wherein the HCDR1, HCDR2, HCDR3, LCDR1, LCDR2, and LCDR3 comprise the amino acid sequence of SEQ ID NOs:447, 448, 449, 567, 568, and 569, respectively.

11. The isolated monoclonal antibody or antigen-binding fragment thereof of claim 1, comprising a heavy chain variable region comprising the amino acid sequence of SEQ ID NO:292 and a light chain variable region comprising the amino acid sequence of SEQ ID NO:332.

12. A pharmaceutical composition, comprising the isolated monoclonal antibody or antigen-binding fragment thereof of claim 1 and a pharmaceutically acceptable carrier.

13. A method of producing a pharmaceutical composition comprising the monoclonal antibody or antigen-binding fragment of claim 1, comprising combining the monoclonal antibody or antigen-binding fragment thereof with a pharmaceutically acceptable carrier to obtain the pharmaceutical composition.

14. An isolated nucleic acid encoding the monoclonal antibody or antigen-binding fragment thereof claim 1.

15. A vector comprising the isolated nucleic acid of claim 1.

16. A host cell comprising the vector of claim 15.

17. A method of producing the monoclonal antibody or antigen-binding fragment thereof of claim 1, comprising culturing a cell comprising a nucleic acid encoding the monoclonal antibody or antigen-binding fragment under conditions to produce the monoclonal antibody or antigen-binding fragment, and recovering the antibody or antigen-binding fragment from the cell or culture.

18. A method of treating cancer in a subject in need thereof, comprising administering to the subject the pharmaceutical composition of claim 12, wherein the isolated monoclonal antibody or a fragment thereof, is a bispecific antibody or fragment thereof, having a binding specificity for human and cynomolgus monkey CD33 and a binding specificity for CD3.

19. The method of claim 18, wherein the cancer is a hematologic cancer.

20. The method of claim 19, wherein the hematologic cancer is a leukemia, a lymphoma, or a multiple myeloma.

21. The method of claim 19, wherein the hematologic cancer is acute myeloid leukemia (AML), myelodysplastic syndrome (MDS), acute lymphocytic leukemia (ALL), diffuse large B-cell lymphoma (DLBCL), chronic myeloid leukemia (CML) or blastic plasmacytoid dendritic cell neoplasm (DPDCN).

* * * * *